(12) United States Patent
Sosa et al.

(10) Patent No.: US 9,938,536 B2
(45) Date of Patent: Apr. 10, 2018

(54) TRANSGENIC PLANTS HAVING INCREASED TOLERANCE TO ALUMINUM

(71) Applicant: CERES, INC., Thousand Oaks, CA (US)

(72) Inventors: Julissa Sosa, Northridge, CA (US); Wuyi Wang, Newbury Park, CA (US)

(73) Assignee: Ceres, Inc., Thousand Oaks, CA (US)

( * ) Notice: Subject to any disclaimer, the term of this patent is extended or adjusted under 35 U.S.C. 154(b) by 422 days.

(21) Appl. No.: 14/355,530

(22) PCT Filed: Nov. 1, 2012

(86) PCT No.: PCT/US2012/062977
§ 371 (c)(1),
(2) Date: Apr. 30, 2014

(87) PCT Pub. No.: WO2013/067128
PCT Pub. Date: May 10, 2013

(65) Prior Publication Data
US 2015/0004302 A1    Jan. 1, 2015

Related U.S. Application Data

(60) Provisional application No. 61/554,788, filed on Nov. 2, 2011.

(51) Int. Cl.
| | | |
|---|---|---|
| C12N 15/82 | (2006.01) |
| A23L 1/36 | (2006.01) |
| A23K 1/00 | (2006.01) |
| C07K 14/415 | (2006.01) |
| A23K 10/00 | (2016.01) |
| A23L 5/00 | (2016.01) |
| A23L 7/10 | (2016.01) |
| A23L 25/00 | (2016.01) |

(52) U.S. Cl.
CPC .......... *C12N 15/8271* (2013.01); *A23K 10/00* (2016.05); *A23L 5/00* (2016.08); *A23L 7/10* (2016.08); *A23L 25/00* (2016.08); *C07K 14/415* (2013.01); *C12N 15/8216* (2013.01); *A23V 2002/00* (2013.01)

(58) Field of Classification Search
None
See application file for complete search history.

(56) References Cited

U.S. PATENT DOCUMENTS

| | | |
|---|---|---|
| 4,987,071 A | 1/1991 | Cech et al. |
| 5,034,323 A | 7/1991 | Jorgensen et al. |
| 5,204,253 A | 4/1993 | Sanford et al. |
| 5,231,020 A | 7/1993 | Jorgensen et al. |
| 5,254,678 A | 10/1993 | Haseloff et al. |
| 5,538,880 A | 7/1996 | Lundquist et al. |
| 5,766,847 A | 6/1998 | Jackle et al. |
| 5,878,215 A | 3/1999 | Kling et al. |
| 6,013,863 A | 1/2000 | Lundquist et al. |
| 6,326,527 B1 | 12/2001 | Kirihara et al. |
| 6,329,571 B1 | 12/2001 | Hiei |
| 6,423,885 B1 | 7/2002 | Waterhouse et al. |
| PP13,008 P2 | 9/2002 | Walsh |
| 6,452,067 B1 | 9/2002 | Bedbrook et al. |
| 6,573,099 B2 | 6/2003 | Graham |
| PP14,743 P2 | 5/2004 | Speichert et al. |
| 6,753,139 B1 | 6/2004 | Baulcombe et al. |
| 6,777,588 B2 | 8/2004 | Waterhouse et al. |
| PP15,193 P2 | 9/2004 | Smith et al. |
| 6,906,244 B2 | 6/2005 | Fischer et al. |
| PP16,176 P3 | 1/2006 | Cosner et al. |
| 7,179,904 B2 | 2/2007 | Kwok |
| PP18,161 P2 | 10/2007 | Probst |
| 7,582,809 B2 * | 9/2009 | Kochian .............. C07K 14/415 435/243 |
| 8,299,318 B2 | 10/2012 | Brover et al. |
| 2003/0175783 A1 | 9/2003 | Waterhouse et al. |
| 2003/0175965 A1 | 9/2003 | Lowe et al. |
| 2003/0180945 A1 | 9/2003 | Wang et al. |
| 2004/0214330 A1 | 10/2004 | Waterhouse et al. |
| 2005/0032221 A1 | 2/2005 | Chang et al. |
| 2006/0015970 A1 | 1/2006 | Pannell et al. |
| 2006/0123505 A1 | 6/2006 | Kikuchi et al. |
| 2006/0265788 A1 | 11/2006 | Rommens |
| 2007/0056058 A1 | 3/2007 | Olivier et al. |
| 2009/0144847 A1 | 6/2009 | Shaikh et al. |

(Continued)

FOREIGN PATENT DOCUMENTS

| | | |
|---|---|---|
| EP | 0 534 858 | 4/2000 |
| WO | WO 1996/034959 | 11/1996 |

(Continued)

OTHER PUBLICATIONS

Delhaize and Ryan, 1995, Plant Physiology 107: 315-321.*
Olsen et al., 2005, Trends in Plant Science 10: 79-87.*
Kumari et al., 2008, Mol. Genet. Genomics 279: 339-357.*
Zea mays clone 219367 NAC domain-containing protein 67 mRNA, GenBank Accession No. EU959686.1, published Dec. 10, 2008.*
Keskin et al., 2004, Protein Science 13: 1043-1055.*
Thornton et al., 2000, Nature Structural Biology, structural genomic supplement, Nov. 2000: 991-994.*
Guo et al., 2004, Proceedings of the National Academy of Sciences USA 101: 9205-9210.*
Hu et al., 2006 PNAS 103(35): 12987-12992.
Nakashima et al., 2012 BBA 1819(2): 97-103.
U.S. Appl. No. 60/637,140, Feldmann, filed Dec. 16, 2004.
U.S. Appl. No. 60/619,181, Medrano, filed Oct. 14, 2004.
U.S. Appl. No. 60/612,891, Kwok, filed Sep. 23, 2004.
U.S. Appl. No. 60/583,691, Alexandrov et al., filed Jun. 30, 2004.
U.S. Appl. No. 60/583,609, Alexandrov, filed Jun. 30, 2004.
U.S. Appl. No. 60/558,869, Cook et al., filed Apr. 1, 2004.

(Continued)

*Primary Examiner* — Amjad Abraham
*Assistant Examiner* — Bratislav Stankovic
(74) *Attorney, Agent, or Firm* — Dentons US LLP

(57) ABSTRACT

Methods and materials for modulating aluminum tolerance in plants are disclosed. For example, nucleic acids encoding aluminum tolerance-modulating polypeptides are disclosed as well as methods for using such nucleic acids to transform plant cells. Also disclosed are plants having increased tolerance to aluminum and methods of increasing plant yield in soil containing elevated levels of aluminum.

20 Claims, 18 Drawing Sheets

(56) References Cited

U.S. PATENT DOCUMENTS

| | | | |
|---|---|---|---|
| 2009/0276918 | A1 | 11/2009 | Choi et al. |
| 2010/0223695 | A1 | 9/2010 | Sivasankar et al. |
| 2010/0287662 | A1 | 11/2010 | Niu et al. |
| 2011/0093981 | A9 | 4/2011 | La Rosa et al. |
| 2011/0217776 | A1 | 9/2011 | Hu et al. |
| 2012/0102599 | A1 | 4/2012 | Kim et al. |
| 2012/0131696 | A1 | 5/2012 | Aayal et al. |
| 2012/0216318 | A1 | 8/2012 | La Rosa et al. |

FOREIGN PATENT DOCUMENTS

| | | | |
|---|---|---|---|
| WO | WO 97/01952 | | 1/1997 |
| WO | WO 98/36083 | | 8/1998 |
| WO | WO 98/53083 | | 11/1998 |
| WO | WO 99/32619 | | 7/1999 |
| WO | WO 02/46449 | | 6/2002 |
| WO | WO 2005/098007 | | 10/2005 |
| WO | WO 2006/005023 | | 1/2006 |
| WO | WO 2006/034479 | | 3/2006 |
| WO | WO 2006/036864 | | 4/2006 |
| WO | WO 2007/044988 | | 4/2007 |
| WO | WO 2007/055826 | | 5/2007 |
| WO | WO 2007/120989 | | 10/2007 |
| WO | 2009/038581 | A2 * | 3/2009 |
| WO | WO 2009/038581 | | 3/2009 |
| WO | WO 2009/099899 | | 8/2009 |
| WO | WO2009/127441 | | 10/2009 |
| WO | WO 2009/146015 | | 12/2009 |

OTHER PUBLICATIONS

U.S. Appl. No. 60/544,771, Cook et al., filed Feb. 13, 2004.
U.S. Appl. No. 60/518,075, Pennell et al., filed Nov. 6, 2003.
U.S. Appl. No. 60/505,689, Cook et al., filed Sep. 23, 2003.
U.S. Appl. No. 60/757,544, Dang, filed Jan. 9, 2006.
U.S. Appl. No. 60/776,307, Kwok et al., filed Feb. 24, 2006.
Abler and Scandalios, "Isolation and characterization of a genomic sequence encoding the maize Cat3 catalase gene," Plant Mol. Biol., Sep. 1993, 22:1031-1038.
Akashi et al., "Gene discovery by ribozyme and siRNA libraries," Nature Reviews Mol. Cell Biology, May 2005, 6:413-422.
Alonso-Blanco et al. "Arabidopsis Protocols," Methods in Molecular Biology, 1998, 82:137-146.
Baerson et al., "Developmental regulation of an acyl carrier protein gene promoter in vegetative and reproductive tissues," Plant Mol. Biol., 1993, 22(2):255-267.
Bateman et al., "Pfam 3.1: 1313 multiple alignments and profile HMMs match the majority of proteins," Nucl. Acids Res., 1999, 27:260-262.
Braga et al., "Expression of the Cry1Ab Protein in Genetically Modified Sugarcane for the Control of Diatraea saccharalis (Lepidoptera: Crambidae)," Journal of New Seeds, 2003, 5:209-221.
Burr et al., "Gene Mapping with Recombinant Inbreds in Maize," Genetics, 1988, 118: 519-526.
Burr et al., "Mapping Genes with Recombinant Inbreds," The Maize Handbook, 1994, pp. 249-254.
Bustos et al., "Regulation of B-Glucuronidase Expression in Transgenic Tobacco Plants by an A/T-Rich, cis-Acting Sequence Found Upstream of a French Bean B-Phaseolin Gene," The Plant Cell, 1989, 1(9):839-853.
Cerdan et al., "A 146 bp fragment of the tobacco Lhcb1*2 promoter confers very-low-fluence and high-irradiance responses of phytochrome to a minimal CaMV 35S promoter," Plant Mol. Biol., 1997, 33:245-255.
Chen et al., "Functional analysis of regulatory elements in a plant embryo-specific gene," Proc. Natl. Acad. Sci. USA, 1986, 83:8560-8564.
Chenna et al., "Multiple sequence alignment with the Clustal series of programs," Nucleic Acids Res., 2003, 31(13):3497-500.
Christian et al., "Targeting DNA double-strand breaks with TAL effector nucleases," Genetics, Oct. 2010, 186: 757-761.
Conceicao, "A cotyledon regulatory region is responsible for the different spatial expression patterns of Arabidopsis 2S albumin genes," The Plant Journal, 1994, 5:493-505.
Conkling et al., "Isolation of Transcriptionally Regulated Root-Specific Genes from Tobacco," Plant Physiol., 1990, 93:1203-1211.
Dai et al., "RF2b, a rice bZIP transcription activator, interacts with RF2a and is involved in symptom development of rice tungro disease," Proc. Natl. Acad. Sci. USA, 2004, 101(2):687-692.
De Feyter and Gaudron, "Expressing Ribozymes in Plants," Methods in Molecular Biology, 1997, 74(43):403-415.
Do et al., "ProbCons: Probabilistic consistency-based multiple sequence alignment," Genome Res., 2005, 15(2):330-40.
Durbin et al., Biological Sequence Analysis: Probabilistic Models of Proteins and Nucleic Acids, Cambridge University Press, Cambridge, UK (1998).
Fang et al., "Systematic sequence analysis and identification of tissue-specific or stress-responsive genes of NAC transcription factor family in rice," Mol. Genet. Genomics, Dec. 2008, 280:547-563.
Fejes et al., "A 268 bp upstream sequence mediates the circadian clock-regulated transcription of the wheat Cab-1 gene in transgenic plants," Plant Mol. Biol., 1990, 15:921-932.
Fromm et al., An Octopine Synthase Enhancer Element Directs Tissue-Specific Expression and Binds ASF-1, a Factor from Tobacco Nuclear Extracts, The Plant Cell, 1989, 1:977-984.
Gardiner et al., "Development of a Core RFLP Map in Maize Using an Immortalized F2 Population," Genetics Society of America, 1993, 134: 917-930.
National Center for Biotechnology Information GenBank Accession No. AF096096, "Genes controlling fertilization-independent seed development in Arabidopsis thaliana," 1999, 2 pages.
National Center for Biotechnology Information GenBank Accession No. AF129516, "Mutations in FIE, a WD polycomb group gene, allow endosperm development without fertilization," 1999, 2 pages.
National Center for Biotechnology Information GenBank Accession No. L05934, "Isolation and characterization of a genomic sequence encoding the maize Cat3 catalase gene," 1993, 3 pages.
National Center for Biotechnology Information GenBank Accession No. U93215, "Arabidopsis thaliana chromosome 2 BAC T6B20 genomic sequence," 2002, 42 pages.
Green et al., "Binding site requirements for pea nuclear protein factor GT-1 correlate with sequences required for light-dependent transcriptional activation of the rbcS-3A gene," The EMBO J., 1988, 7:4035-4044.
Hong et al., "Promoter sequences from two different Brassica napus tapetal oleosin-like genes direct tapetal expression of B-glucuronidase in transgenic Brassica plants," Plant Mol. Biol., 1997, 34(3):549-555.
Hyrup et al., "Peptide Nucleic Acids (PNA): Synthesis, Properties and Potential Applications," Bioorganic & Medicinal Chemistry, 1996, 4(1):5-23.
Hwang et al. "Aleurone- and embryo-specific expression of the β-glucuronidase gene controlled by the barley Chi26 and Ltp1 promoters in transgenic rice," Plant Cell Reports, 2001, 20:647-654.
International Preliminary Report on Patentability in International Application No. PCT/US2012/062977, dated May 6, 2014, 10 pages.
International Search Report and Written Opinion in International Application No. PCT/US2012/062977, dated Feb. 25, 2013, 8 pages.
Jordano et al., "A Sunflower Helianthinin Gene Upstream Sequence Ensemble Contains an Enhancer and Sites of Nuclear Protein Interaction," The Plant Cell, 1989, 1:855-866.
Kasuga et al., "Improving plant drought, salt, and freezing tolerance by gene transfer of a single stress-inducible transcription factor," Nature Biotechnology, 1999, 17: 287-291.
Keller and Baumgartner, "Vascular-Specific Expression of the Bean GRP 1.8 Gene is Negatively Regulated," The Plant Cell, 1991, 3(10):1051-1061.
Kochian, "Cellular Mechanisms of Aluminum Toxicity and Resistance in Plants," Annu. Rev. Plant Biol., Jun. 1995, 46:237-260.

(56) References Cited

OTHER PUBLICATIONS

Lam et al., "Site-specific mutations alter in vitro factor binding and change promoter expression pattern in transgenic plants," Proc. Natl. Acad. Sci. USA, 1989, 86:7890-7894.
Li et al., "Small dsRNAs induce transcriptional activation in human cells," Proc Natl Acad Sci USA, Nov. 2006, 103(46):17337-42.
Lloyd et al., "Targeted mutagenesis using zinc-finger nucleases in Arabidopsis," Proc. Natl. Acad. Sci. USA, Feb. 2005, 102:2232-2237.
Luan et al., A Rice cab Gene Promoter Contains Separate cis-Acting Elements That Regulate Expression in Dicot and Monocot Plants, The Plant Cell, Aug. 1992, 4:971-981.
Lubberstedt et al., "Promoters from Genes for Plastid Proteins Possess Regions with Different Sensitivities toward Red and Blue Light," Plant Physiol., 1994, 104:997-1006.
Matsuoka et al., "Tissue-specific light-regulated expression directed by the promoter of a C4 gene, maize pyruvate, orthophosphate dikinase, in a C3 plant, rice," Proc. Natl. Acad. Sci. USA, Oct. 1993, 90:9586-9590.
Matzke and Birchler, "RNAi-Mediated Pathways in the Nucleus," Nature Reviews Genetics, Jan. 2005, 6:24-35.
McCallum et al., "Targeted screening for induced mutations," Nature Biotechnology, Apr. 2000, 18: 455-457.
Medberry et al., "The Commelina Yellow Mottle Virus Promoter Is a Strong Promoter in Vascular and Reproductive Tissues," The Plant Cell, Feb. 1992, 4(2):185-192.
Meier et al., "Elicitor-Inducible and Constitutive in Vivo DNA Footprints Indicate Novel cis-Acting Elements in the Promoter of a Parsley Gene Encoding Pathogenesis-Related Protein 1," The Plant Cell, Mar. 1991, 3:309-316.
Mittal, "Improving the Efficiency of RNA Interference in Mammals," Nature Reviews Genetics, May 2004, 5:355-365.
Moore and Haber, "Cell cycle and genetic requirements of two pathways of nonhomologous end-joining repair of double-strand breaks in *Saccharomyces* cerevisiae," Mol Cell Biol., May 1996, 16(5):2164-2173.
Nature.Com, "Nature Reviews RNA interference collection," Oct. 2005, [retrieved on Apr. 12, 2012]. Retrieved from Internet: URL http://www.nature.com/focus/rnai/index.html. 2 pages.
Ooka et al., "Comprehensive analysis of NAC family genes in Oryza sativa and Arabidopsis thaliana," DNA Res., Dec. 2003, 20: 239-247.
Perriman et al., "Effective ribozyme delivery in plant cells," Proc. Natl. Acad. Sci. USA, Jun. 1995, 92(13):6175-6179.
Refseth et al., "Hybridization capture of microsatellites directly from genomic DNA," Electrophoresis, 1997, 18:1519-1523.
Rhoads and Friedberg, "Sequence motifs for calmodulin recognition," FASEB J., 1997, 11(5):331-340.
Richards et al., "Construction of a GFP-BAR plasmid and its use for switchgrass transformation," Plant Cell. Rep., 2001, 20:48-54.
Riggs et al., "Cotyledon Nuclear Proteins Bind to DNA Fragments Harboring Regulatory Elements of Phytohemagglutinin Genes," The Plant Cell, Jun. 1989, 1(6):609-621.
Rivera et al., "Genomic evidence for two functionally distinct gene classes," Proc. Natl. Acad. Sci. USA, May 1998, 95:6239-6244.
Ryan et al., "The identification of aluminum-resistance genes provides opportunities for enhancing crop production on acid soils," Journal of Experimental Botany, Jan. 2011, 62:9-20.
Sanchez et al. "Replenishing Soil Fertility in Africa," Agroforestry Systems, Sep. 1998, 42(3):291-294.
Shaff et al., "Geochem-EZ: a chemical speciation program with greater power and flexibility," Plant Soil, 2010, 330: 207-214.
Sheridan et al., "The macl Gene: Controlling the Commitment to the Meiotic Pathway in Maize," Genetics, 1996, 142:1009-1020.
Shibuya et al., "RNA-directed DNA methylation induces transcriptional activation in plants," Proc Natl Acad Sci USA, Feb. 2009,106(5):1660-1665.
Slocombe et al., "Temporal and Tissue-Specific Regulation of a Brassica napus Stearoyl-Acyl Carrier Protein Desaturase Gene," Plant Physiol., 1994, 104(4):167-176.
Somleva et al., "Agrobacterium-Mediated Genetic Transformation of Switchgrass," Crop Sci., 2002, 42:2080-2087.
Sonnhammer et al., "Pfam: A Comprehensive Database of Protein Domain Families Based on Seed Alignments," Proteins, 1997, 28:405-420.
Sonnhammer et al., "Pfam: multiple sequence alignments and HMM-profiles of protein domains," Nucl. Acids Res., 1998, 26:320-322.
Souer et al., "The no apical meristem gene of Petunia is required for pattern formation in embryos and flowers and is expressed at meristem and primordia boundaries," Cell, Apr. 1996, 85:159-170.
Stemple, "Tilling—a high-throughput harvest for functional genomics," Nat Rev Genet, Feb. 2004, 5(2):145-50.
Summerton and Weller, "Morpholino Antisense Oligomers: Design, Preparation, and Properties," Antisense Nucleic Acid Drug Dev., 1997, 7:187-195.
Tovkach et al., "A toolbox and procedural notes for characterizing novel zinc finger nucleases for genome editing in plant cells," The Plant Journal, 2009, 57:747-757.
Townsend et al., "High-frequency modification of plant genes using engineered zinc-finger nucleases," Nature, May 2009, 459:442-445.
Truernit et al., "The promoter of the Arabidopsis thaliana SUC2 sucrose-H+ symporter gene directs expression of B-glucuronidase to the phloem: Evidence for phloem loading and unloading by SUC2," Planta, 1995, 196:564-570.
Urao et al, "Molecular cloning and characterization of a gene that encodes a MYC-related protein in Arabidopsis," Plant Mol. Biol., 1996, 32:571-57.
Vij and Tyag, "Genome-wide analysis of the stress associated protein (SAP) gene family containing A20/AN1 zinc-finger(s) in rice and their phylogenetic relationship with Arabidopsis," Mol Genet Genomics, Dec. 2006, 276(6):565-75.
Weigel et al., "Activation Tagging in Arabidopsis," Plant Physiology, Apr. 2000, 122:1003-1013.
Wood, et al. (2000) in Pilot Analysis of Global Ecosystems: Agroecosystems (Int. Food Policy Res, Inst. And World Resources Inst. Washington, DC), pp. 45-54.
Yamamoto et al., "The Promoter of a Pine Photosynthetic Gene Allows Expression of a B-Glucuronidase Reporter Gene in Transgenic Rice Plants in a Light-Independent but Tissue-Specific Manner," Plant Cell Physiol., 1994, 35:773-778.
Yan et al., "New Construct Approaches for Efficient Gene Silencing in Plants," Plant Physiol., Aug. 2006, 141:1508-1518.
Zhang et al., "DNA Sequences That Activate Isocitrate Lyase Gene Expression during Late Embryogenesis and during Postgerminative Growth," Plant Physiology, 1996, 110:1069-1079.
Zheng et al., "SPK1 Is an Essential S-Phase-Specific Gene of *Saccharomyces* cerevisiae That Encodes a Nuclear Serine/Threonine/Tyrosine Kinase," Mol. Cell Biol., Sep. 1993, 13:5829-5842.
Kumar, Prateek, et al., "Predicting the effects of coding non-synonymous variants on protein function using the SIFT algorithm," Nature Publishing Group, 2009, pp. 1073-1082.
Reva, Boris, et al., "Predicting the functional impact of protein mutations: application to cancer genomics," Nucleic Acids Research, 2011, vol. 39, No. 17, pp. 1-14.
Ng, Pauline C., et al., "Predicting the Effects off Amino Acid Substitutions on Protein Function," Annu. Rev. Genomics Hum. Genet. 2006, pp. 61-80.
Guerois, Raphael, "Predicting Changes in the Stability of Proteins and Protein Complexes: A Study of More Than 1000 Mutations," J. Mol. Biol. (2002) 320, 369-387.
Sandhya, Sankaran, "CUSP: an algorithm to distinguish structurally conserved and unconserved regions in protein domain alignments and its application in the study of large length variations," BioMed Central, May 2008, pp. 1-14.

* cited by examiner

| SEQ_ID_NO_353 | MGKRGKWFSA | VKKVFSSSDP | DGKEAKAQKA | DKSKSKRRWP | 40 |
|---|---|---|---|---|---|
| SEQ_ID_NO_355 | MGKKAKWFSS | VKKAFSPF | DSKKSKQKLA | | 27 |
| SEQ_ID_NO_357 | MGKKGKWFGA | VKKVFSPL | ESKEKKEL | | 25 |
| SEQ_ID_NO_358 | MGKKGINMFSA | VKKVFSSSDP | DGREAKTEKA | DKSRSRRKWP | 40 |
| SEQ_ID_NO_360 | MSR | | | | 3 |
| SEQ_ID_NO_362 | | | | | 0 |
| SEQ_ID_NO_364 | MGKKGGMLS | VKKALSP | ESKKSQHQ | TPKPKKKW | 33 |

| SEQ_ID_NO_353 | EGKSKHSEP | SISTVP---G | TAPAVAPLPS | PPA--TQPHS | 74 |
|---|---|---|---|---|---|
| SEQ_ID_NO_355 | EGQNGVISNP | PMVD- | NMRQ | SSSI--SPPPA | 53 |
| SEQ_ID_NO_357 | | | | | 25 |
| SEQ_ID_NO_358 | EGKSKKSDP | WTSTVAVPTS | TAPPQPPP | PPTHPIQPQP | 79 |
| SEQ_ID_NO_360 | | | | | 3 |
| SEQ_ID_NO_362 | | | | | 0 |
| SEQ_ID_NO_364 | EGKSKNLSP | V | | SVPEE | 48 |

| SEQ_ID_NO_353 | --ELKDVNP | VETDSEQNKH | AYSVALASAV | AAEAA--AV | 109 |
|---|---|---|---|---|---|
| SEQ_ID_NO_355 | LAPREVRV | AEVIVERNRD | LSPPSITADAV | NVTAITDXPVV | 91 |
| SEQ_ID_NO_357 | | | | | 25 |
| SEQ_ID_NO_358 | EEIKDVKA | VETDSEQNKH | AYSVALASAV | AAEAA--AV | 114 |
| SEQ_ID_NO_360 | | | | | 3 |
| SEQ_ID_NO_362 | | | | | 0 |
| SEQ_ID_NO_364 | TEVITEDAKL | KEAENEQSKH | AYSVALATAV | AAEAA--VA | 85 |

| SEQ_ID_NO_353 | AAQAAAEVVR | LTAVTTAAPK | MPVSSREELA | ATKIQTAFRG | 149 |
|---|---|---|---|---|---|
| SEQ_ID_NO_355 | PSSSAPGNVR | RATPIT--R | FAGKSNEEA | AILQTIFERG | 127 |
| SEQ_ID_NO_357 | | | | | 25 |
| SEQ_ID_NO_358 | AAQAAAEVVR | LTTATTAMPK | SPVSSKDELA | AIKIQTAFRG | 154 |
| SEQ_ID_NO_360 | | | | | 16 |
| SEQ_ID_NO_362 | | | | | 0 |
| SEQ_ID_NO_364 | | LTSQP---R | HLGKSKEELA | AIRIQTAFRG | 121 |

| | | | | | |
|---|---|---|---|---|---|
| SEQ_ID_NO_353 | EKL---EVPE | R-APLAHSMV | KKRLSFPVVE | KPSVVPTEKP | 474 |
| SEQ_ID_NO_355 | G---TITQE | NEGFTDKASA | KKRLSYPITSP | AL------ | 436 |
| SEQ_ID_NO_357 | NGA---ETPE | KI-SIGPA | KKRLSFQGGT | AA------ | 187 |
| SEQ_ID_NO_358 | DRF---EVPE | RI-VPLVHSSL | KKRLSFPVAD | KPNGEHADKL | 476 |
| SEQ_ID_NO_360 | EGAJQAETLE | KI-GWSSVGSA | KKRLSFPAGT | PPPV----- | 348 |
| SEQ_ID_NO_362 | DNN---GTPD | A--SVGYM | KKRLSFSASP | A------- | 292 |
| SEQ_ID_NO_364 | S---GTPD | R--VAGSA | KKRLLFPASP | A------P | 443 |

| | | | | | |
|---|---|---|---|---|---|
| SEQ_ID_NO_353 | RER VRRHSDP | PKVDPATLK- | -------- | D-APAA | 498 |
| SEQ_ID_NO_355 | -PKP RRFSAP | PKVESGGVT- | -------VT | N-GAGS | 461 |
| SEQ_ID_NO_357 | ASP MRRHSGP | PKVEIAPPQP | -------VV | N-GGSK | 217 |
| SEQ_ID_NO_358 | MER GRRHSGP | PKVPASLK- | EAL----- | D-VPVS | 500 |
| SEQ_ID_NO_360 | AAA RRHSGP | PKVRQAGVEG | GTE---ER | DLSSLA | 378 |
| SEQ_ID_NO_362 | ---GARRHSGP | PRVDASAMKD | IQMHREEKMS | NG-ASSK | 326 |
| SEQ_ID_NO_364 | ---SSRRHSEP | PKVDISEARK | NQH---APS | NGRQVAW | 474 |

FIGURE 1D

| SEQ_ID_NO | Sequence | Pos |
|---|---|---|
| SEQ_ID_NO_237 | MAQRTEK-EETEFK-VLE-TL-T-TLC-TNNCGVTANP | 36 |
| SEQ_ID_NO_239 | MAQRTEK-EETEFK-VPE-TL-T-TLC-VNNCGVTGNP | 31 |
| SEQ_ID_NO_241 | MAQRDKK-EETEFK-APE-LL-T-TLC-ANSCGFPGNP | 32 |
| SEQ_ID_NO_243 | MAQRDKKVEE-TELR-APE-L-T-TLC-ANNCGFPGNP | 31 |
| SEQ_ID_NO_245 | MAQRTEK-EEPTELR-APE-L-TTP-PLC-SNNCGVTANP | 35 |
| SEQ_ID_NO_246 | MAQTEK-EETEFK-VLE-TL-T-TLC-VNNCGFTGNP | 31 |
| SEQ_ID_NO_248 | MAQKTEK-EETEFK-VPE-TL-T-ALC-VNNCGVTGNP | 31 |
| SEQ_ID_NO_250 | MAQRTEK-EETDFK-VPE-TL-T-TLC-NNCGVTGNP | 31 |
| SEQ_ID_NO_251 | MAQRTEK-EETECK-VPE-NL-T-TLC-NNCGVIGNP | 32 |
| SEQ_ID_NO_253 | MAQRTEK-EETEFKAVPE-TI-T-TLC-NNCGVVGAP | 32 |
| SEQ_ID_NO_255 | MAQRD-K-EETEMK-VSE-SL-T-SLC-NNCGFSGNP | 30 |
| SEQ_ID_NO_257 | MAQRLEK-EEAKLH-APE-TL-T-TLC-VNNCGFPGNP | 30 |
| SEQ_ID_NO_258 | MAQRDKK-EEPTELR-APE-L-T-TLC-ANGCGFPGNP | 31 |

| SEQ_ID_NO | Sequence | Pos |
|---|---|---|
| SEQ_ID_NO_237 | ATNNMCQKCF-NASLVSAAAG-VVESGSI L-------- | 64 |
| SEQ_ID_NO_239 | ATNNMCQKCF-SATTAATSS-SSSSSSTN-N--TATSA-A | 64 |
| SEQ_ID_NO_241 | ATNNLCQACF-QAATASSAS-ASVSPPSP-SSLSPSP-A | 68 |
| SEQ_ID_NO_243 | ATONLCQSCF-SAATASMSS-SPTSSSSS-SI-TAPAP-A | 64 |
| SEQ_ID_NO_245 | ATONLCQSCF-NASVAAGV-DSTSI L-------- | 60 |
| SEQ_ID_NO_246 | ATNNMCQKCF-SASASAAA-AAGALKS-SH-KVSG- | 64 |
| SEQ_ID_NO_248 | ATNNMCQKCF-TAFTSTAT-TSGAGGAG-I-A----- | 60 |
| SEQ_ID_NO_250 | ATNNMCQKCF-NATTTNGVS-TNEIL-KF------- | 57 |
| SEQ_ID_NO_251 | ATNNMCQKCF-NATTAATST-SSSSPTGT-SV-PHNF-A | 68 |
| SEQ_ID_NO_253 | ATNNMCQKCF-TATTSHRT-Q-------------- | 51 |
| SEQ_ID_NO_255 | ATKNMCQSCY-KISTGIMTQ-PALTFSG-------- | 56 |
| SEQ_ID_NO_257 | ATNNMCQSCF-QASTLAASP-APHSC--------- | 54 |
| SEQ_ID_NO_258 | ATONLCQNCF-SAASASTSS-PPSPSSI-------- | 57 |

| SEQ_ID_NO_237 | KKRDQQLVNR | CSGCRKKVGL | TGFRCRCGEL | FCSEHRYSDR | 130 |
|---|---|---|---|---|---|
| SEQ_ID_NO_239 | DTAEKKSVNR | CSGCRKRVGL | TGFRCRCGEL | FCSDHRYSDR | 150 |
| SEQ_ID_NO_241 | STSSSSSVNR | QSCRKRVGL | TGFRCRCGEL | FCGAHRYSDR | 146 |
| SEQ_ID_NO_243 | KAPARTSANR | CSSCRKRVGL | TGFRCRCGEL | FCAEHRYSDR | 133 |
| SEQ_ID_NO_245 | -KRDQQITNR | CSGCRKRVGL | TGFRCRCGEL | FCAEHRYTDR | 125 |
| SEQ_ID_NO_246 | DSLVKREVNR | CSGCRKRVGL | TGFRCRCGEL | FCMEHRYSDR | 120 |
| SEQ_ID_NO_248 | PSEAKRVNR | CSGCRRRVGL | TGFRCRCGDL | FCGEHRYSDR | 134 |
| SEQ_ID_NO_250 | SSVAKKEVNR | CSGCRKRVGL | TGFRCRCGEL | YCSEHRYSDR | 130 |
| SEQ_ID_NO_251 | LPPAKREVNR | CSGCRKRVGL | TGFRCRCGDL | FCGEHRYSDR | 158 |
| SEQ_ID_NO_253 | VVVKKEVSNR | CSGCRKRVGL | TGFRCRCGDM | FCSEHRYSDR | 126 |
| SEQ_ID_NO_255 | IVEKKQEVNR | CSGCRKRVGL | TGFRCRCGDL | FCGEHRYSDR | 140 |
| SEQ_ID_NO_257 | APAPARQVSR | CFSCRKRVGL | TGFRCRCGEL | FCSEHRYSDR | 125 |
| SEQ_ID_NO_258 | VKAGKTSVNR | CSSCRKRVGL | TGFRCRCGEL | FCGEHRYSDR | 135 |

| SEQ_ID_NO_237 | HDCSYDYKTA | GREAIARENP | VVKAAKMVKV | 160 |
|---|---|---|---|---|
| SEQ_ID_NO_239 | DTAEKKS... HDCSYDYKAA | GREAIARENP | VVKAAKIIRV | 180 |
| SEQ_ID_NO_241 | HDCQFDYKAV | GRDAIARENP | VVRAAKIVRF | 176 |
| SEQ_ID_NO_243 | HGCSYDYKGA | ARDAIARENP | VVKAAKIVRF | 163 |
| SEQ_ID_NO_245 | HDCSYDYKTA | GREAIARENP | VVKAAKIVKV | 155 |
| SEQ_ID_NO_246 | HECSYDYKAA | GREAIARENP | VIRAAKIVKV | 150 |
| SEQ_ID_NO_248 | HDCSYDYKAA | GREAIARENP | VVKAAKIVRV | 164 |
| SEQ_ID_NO_250 | HDCSYDYKTV | GREAIARENP | VVKAAKIIKV | 160 |
| SEQ_ID_NO_251 | HDCSYDYKAV | GREAIARDNP | VVKAAKIVRI | 188 |
| SEQ_ID_NO_253 | HDCSFDYKAA | GREVIARQNP | VVKAAKIIRL | 156 |
| SEQ_ID_NO_255 | HDCSYDYKAA | GRESIARQVI | VVKAAKIVRV | 170 |
| SEQ_ID_NO_257 | HDCSYDYKAA | ARVAIARANP | VVKAAKIVRV | 155 |
| SEQ_ID_NO_258 | HGCSYDYKAA | TRDAIARDNP | VVRAAKIVRF | 165 |

| | | | | | |
|---|---|---|---|---|---|
| SEQ_ID_NO_451 | TTFCGSHRYP | EVHGCTFDFK | SAGREEIAKA | NPLVIAAKLQ | 159 |
| SEQ_ID_NO_453 | VTFCGSHRYP | ENHGCTFDFK | KVGREEIARA | NPLVKAGKLE | 159 |
| SEQ_ID_NO_454 | LTFCGSHRYP | EQHGCTFDFK | TLGKEAISKA | NPVVKAEKLH | 159 |
| SEQ_ID_NO_456 | TTFCGSHRYP | EKHACGFDFK | AVGREEIARA | NPVIKGEKLR | 162 |
| SEQ_ID_NO_457 | SMFCGAHRYP | EKHNCTFDFK | KIGREAIARE | NPLVWAQKLH | 164 |
| SEQ_ID_NO_458 | VTFCGAHRYP | EKHACSFDFK | TVGREAIAKA | NPVVRAEKLH | 163 |
| SEQ_ID_NO_459 | TTFCGAHRYP | EIHGCSFDFK | SIGREAIAKA | NPVVKAKKL | 155 |
| SEQ_ID_NO_460 | MVFCGTHRYP | EQHDCEFDFK | SLGKEQIAKA | NPVVKGEKLQ | 157 |
| SEQ_ID_NO_461 | MTFCGTHRYP | EQHACGFDFR | GMGKEQIAKA | NPVVKADKLQ | 160 |
| SEQ_ID_NO_462 | TTFCGTHRYP | EIHGCSFDFK | SIGREAIAKA | NPL | 149 |
| SEQ_ID_NO_463 | NTFCGLHRYA | EKHSCSFDFK | AAGREAIARA | NPVVKAAKID | 179 |
| SEQ_ID_NO_465 | ATYCGVHRYA | EQHDCTFDFK | AAGRATIARA | NPVVKADKLH | 145 |
| SEQ_ID_NO_467 | DTFCSTHRYT | DSHQCTFDYK | KVAREQIAKQ | NPVVMAEKIN | 161 |
| SEQ_ID_NO_468 | NLYCAMHRYS | DKHDCQFDYR | TAARDAIAKA | NPVVKAEKLD | 169 |
| SEQ_ID_NO_469 | GTFCSLHRYT | DSHECTFDYK | KVAREQIAKQ | NPVVIAEKIN | 157 |

| | | |
|---|---|---|
| SEQ_ID_NO_451 | KI | 161 |
| SEQ_ID_NO_453 | KI | 161 |
| SEQ_ID_NO_454 | KI | 161 |
| SEQ_ID_NO_456 | RI | 164 |
| SEQ_ID_NO_457 | KI | 166 |
| SEQ_ID_NO_458 | RL | 165 |
| SEQ_ID_NO_459 | G | 156 |
| SEQ_ID_NO_460 | RI | 159 |
| SEQ_ID_NO_461 | KI | 162 |
| SEQ_ID_NO_462 | | 149 |
| SEQ_ID_NO_463 | KL | 181 |
| SEQ_ID_NO_465 | KI | 147 |
| SEQ_ID_NO_467 | KI | 163 |
| SEQ_ID_NO_468 | KI | 171 |
| SEQ_ID_NO_469 | KI | 159 |

FIGURE 3C

| SEQ_ID_NO_2 | MV- - - - - | - - - - - - - | - - - - AQ | RRDAEAELNL | PPGFRFHPTD | 24 |
|---|---|---|---|---|---|---|
| SEQ_ID_NO_3 | MVAMA- - | - - - - - - - | AVQQQQQQ | RRDAEAELNL | PPGFRFHPTD | 34 |
| SEQ_ID_NO_4 | MVMTT- - | - - - - - - - | A- - - - AQQ | RRDAEAELNL | PPGFRFHPTD | 30 |
| SEQ_ID_NO_5 | MVMA- - - | - - - - - - - | - - - - - AQ | RRDAEAELNL | PPGFRFHPTD | 27 |
| SEQ_ID_NO_7 | MGMG- - - | - - - - - - - | - - - - AAE | ERDAEAELNL | PPGFRFHPTD | 27 |
| SEQ_ID_NO_8 | MGF- - - - | - - - - - - - | - - - - MRR | RRDAEAELNL | PPGFRFHPTD | 24 |
| SEQ_ID_NO_9 | MMT- M- - | MVKAEA | MTAEAEIGSSG | RRDAEAELNL | PPGFRFHPTD | 40 |
| SEQ_ID_NO_10 | MK- - - - - | - - - - - - - | - - - - - SR | ERDAEAELNL | PPGFRFHPTD | 23 |
| SEQ_ID_NO_11 | MG- - - - - | - - - - - - - | - - - - - RR | TADAEAANL | PPGFRFEPTD | 24 |
| SEQ_ID_NO_12 | M- - - - - - | - - - - - - - | - - - - - - RK | SSSDLQL | PPGFRFHPTD | 22 |
| SEQ_ID_NO_13 | M- - - - - - | - - - - - - - | - - - - - - - | TTAELQL | PPGFRFHPTD | 18 |
| SEQ_ID_NO_14 | M- - - - - - | - - - - - - - | - - - - - - G | RPNAEAQLNL | PPGFRFHPTD | 18 |
| SEQ_ID_NO_15 | MV- - - - - | - - - - - - - | - - - - - - - | KGGDQQLNL | PAGFRFHPTD | 20 |

| SEQ_ID_NO_2 | EELVAHYLCA | RAAGRGPPVP | IAEVDLYRF | DPWDLPERAL | 64 |
|---|---|---|---|---|---|
| SEQ_ID_NO_3 | EELVAHYLCA | RAAGRRPPVS | IAEVDLYRF | DPWDLPERAL | 74 |
| SEQ_ID_NO_4 | EELVAHYLCA | RAAGRRPPVS | IAEVDLYRF | DPWDLPERAL | 70 |
| SEQ_ID_NO_5 | EELVAHYLCA | RAAGRAPPVP | IAELDLYRF | DPWELPERAL | 67 |
| SEQ_ID_NO_7 | DELVADYLCK | KAAGQRLPVP | IAEVDLYRF | DPWDLPEKAL | 67 |
| SEQ_ID_NO_8 | EELVEHYLCR | KVACQRLPVP | IAEVDLYKF | NPWDLPERAL | 64 |
| SEQ_ID_NO_9 | EELVVHYLCR | KVAGQPQPVP | IAEVDLYKY | DPWDLPEKAL | 80 |
| SEQ_ID_NO_10 | DELVVHYLCR | KASYQTLPVP | IMEIDLYKY | YPWQLPEKAL | 63 |
| SEQ_ID_NO_11 | EELVKHYLCK | KLISQRLPAA | IAEVDLYKF | DPWDLPGLAL | 64 |
| SEQ_ID_NO_12 | DELVVHYLCR | KAASQAIAVP | IAEIDLYKY | NPWDLPDLAL | 62 |
| SEQ_ID_NO_13 | EELVVHYLCR | KCQSQPISMP | IAEIDLYKY | DPWDLPDLAL | 58 |
| SEQ_ID_NO_14 | EELVMHYLCR | KCASQPIAVP | IAEIDLYKF | DPWDLPDLAL | 58 |
| SEQ_ID_NO_15 | EELVVHYLCR | KCAGQQIGVP | VIAEIDLYKF | DPWELPDLAL | 60 |

| | | |
|---|---|---|
| SEQ_ID_NO_2 | GG--FLLF | 290 |
| SEQ_ID_NO_3 | GG--FPFF | 300 |
| SEQ_ID_NO_4 | AG--EPFF | 290 |
| SEQ_ID_NO_5 | VS--PFFF | 287 |
| SEQ_ID_NO_7 | MG--MVPF | 316 |
| SEQ_ID_NO_8 | SD--LPPF | 303 |
| SEQ_ID_NO_9 | TI--GLPY | 316 |
| SEQ_ID_NO_10 | IH--LPPF | 297 |
| SEQ_ID_NO_11 | TN--LPPF | 300 |
| SEQ_ID_NO_12 | VPSYLQRSSM | 387 |
| SEQ_ID_NO_13 | YL--QKPY | 295 |
| SEQ_ID_NO_14 | HL--HKPF | 304 |
| SEQ_ID_NO_15 | YM--QKPF | 303 |

FIGURE 4G

TRANSGENIC PLANTS HAVING INCREASED TOLERANCE TO ALUMINUM

CROSS-REFERENCE TO RELATED APPLICATION

This application is a National Stage Application under 35U.S.C. § 371 and claims the benefit of International Application No. PCT/US2012/062977, filed Nov. 1, 2012, which claims priority to U.S. Application Ser. No. 61/554,788, filed on Nov. 2, 2011, entitled TRANSGENIC PLANTS HAVING INCREASED TOLERANCE TO ALUMINUM, the disclosures of which are incorporated herein by reference.

TECHNICAL FIELD

This document relates to methods and materials involved in modulating tolerance to abiotic stress in plants. For example, this document provides plants having increased aluminum tolerance, materials and methods for making plants having increased aluminum tolerance, as well as methods of increasing plant yield in soil containing elevated levels of aluminum.

INCORPORATION-BY-REFERENCE OF SEQUENCE LISTING

The material in the accompanying sequence listing is hereby incorporated by reference into this application. The accompanying file, named Sequence_Listing_2012-10-30.txt was created on Oct. 30, 2012, and is 1.69 MB. The file can be accessed using Microsoft Word on a computer that uses Windows OS.

BACKGROUND

Aluminum (Al) is ubiquitous in soils and at pH values below 5.0, is solubilized into the soil solution as the highly phytotoxic $Al^3$ species, which inhibits root growth and damages root systems (Kochian, 1995, *Annu. Rev. Plant Biol.* 46: 237-260). As such, aluminum toxicity is aggravated by acid precipitation (e.g., acid rain). For example, contaminated soils in Brazil contain aluminum in amounts that range from 11 to 124 g/Kg of soil. Another constraint on acid soils is phosphorous (P) deficiency, which is caused by P fixation with Al and Fe oxides on the surface of clay minerals in acid soils. See Sanchez et al. 1997. In: Replenishing Soil Fertility in Africa, ed. R Buresh, P Sanchez, F Calhoun, pp. 1-46). Root damage reduces water and nutrient uptake and thus crop productivity. Low soil pH has been documented to reduce the yield on nearly 25% of the world's land presently under production. See, Wood, et al. (2000) in Pilot Analysis of Global Ecosystems: Agroecosystems (Int. Food Policy Res, Inst. And World Resources Inst., Washington, D.C.), pp 45-54). Thus, there is a need to provide methods and materials for increasing aluminum tolerance in plants.

SUMMARY

This document provides methods and materials related to plants having increased tolerance to aluminum ($Al^{3+}$). For example, this document provides transgenic plants and plant cells having increased tolerance to aluminum, nucleic acids used to generate transgenic plants and plant cells having increased tolerance to aluminum, methods for making plants having increased tolerance to aluminum, and methods for making plant cells that can be used to generate plants having increased tolerance to aluminum. Such plants and plant cells can be grown in acidic soils containing elevated levels of $Al^{3+}$, resulting in increased yield in such soils.

In one aspect, this document features a method of increasing plant yield in soil containing elevated levels of $Al^{3+}$. The method includes growing a plant comprising an exogenous nucleic acid on soil having an elevated level of $Al^{3+}$, wherein yield of the plant is increased as compared to the corresponding yield of a control plant that does not comprise said nucleic acid.

In some embodiments, the exogenous nucleic acid includes a regulatory region operably linked to a nucleotide sequence encoding a polypeptide, wherein the HMM bit score of the amino acid sequence of the polypeptide is greater than about 65, the HMM based on the amino acid sequences depicted in any one of FIGS. 1-4.

In some embodiments, the exogenous nucleic acid includes a regulatory region operably linked to a nucleotide sequence encoding a polypeptide having 90 percent or greater sequence identity to an amino acid sequence set forth in SEQ ID NOs: 2, 3, 4, 5, 7, 8, 9, 10, 11, 12, 13, 14, 15, 17, 19, 20, 22, 24, 26, 28, 29, 31, 32, 33, 35, 36, 38, 40, 41, 42, 43, 44, 45, 47, 48, 49, 50, 52, 54, 55, 56, 57, 58, 59, 61, 63, 64, 65, 66, 67, 69, 70, 72, 73, 75, 77, 78, 79, 81, 82, 83, 84, 85, 86, 87, 88, 89, 90, 91, 93, 94, 96, 97, 98, 99, 100, 102, 103, 104, 105, 106, 107, 108, 109, 110, 111, 113, 115, 117, 119, 120, 121, 122, 124, 125, 126, 127, 129, 131, 132, 134, 136, 137, 138, 140, 142, 144, 146, 147, 148, 149, 150, 151, 152, 153, 154, 155, 156, 158, 159, 160, 162, 163, 164, 166, 167, 169, 171, 172, 173, 174, 175, 176, 177, 178, 179, 180, 181, 182, 183, 184, 185, 186, 187, 188, 190, 191, 192, 193, 194, 195, 197, 198, 199, 200, 201, 202, 203, 205, 207, 209, 211, 212, 213, 214, 215, 216, 217, 218, 219, 220, 221, 223, 224, 225, 227, 228, 229, 230, 231, 232, 233, 234, 235, 237, 239, 241, 243, 245, 246, 248, 250, 251, 253, 255, 257, 258, 259, 261, 263, 265, 267, 269, 271, 273, 274, 276, 278, 280, 281, 283, 284, 285, 287, 288, 290, 292, 293, 294, 296, 298, 300, 302, 304, 306, 308, 310, 312, 314, 316, 318, 320, 322, 324, 326, 328, 329, 331, 333, 335, 337, 338, 339, 341, 342, 343, 344, 345, 346, 347, 348, 349, 350, 351, 353, 355, 357, 358, 360, 362, 364, 366, 368, 369, 371, 373, 375, 376, 377, 378, 379, 380, 382, 384, 386, 388, 390, 392, 393, 395, 396, 397, 398, 399, 400, 401, 402, 404, 405, 407, 409, 411, 413, 414, 416, 418, 420, 421, 423, 424, 425, 426, 428, 429, 431, 432, 433, 434, 435, 436, 437, 438, 439, 440, 441, 442, 443, 444, 445, 446, 447, 449, 451, 453, 454, 456, 457, 458, 459, 460, 461, 462, 463, 465, 467, 468, 469, 470, 471, 472, 473, 474, 475, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 535, 537, 539, 540, 542, 544, 545, 547, 549, 551, 553, 555, 557, 558, 560, 562, 564, 568, 570, 572, 574, 576, 578, 579, 580, 581, 583, 585, 587, 589, 591, 593, 595, 597, 599, 601, 603, 605, 607, 608, 610, 612, 614, 616, 618, 620, 622, 624, 625, 627, 629, 631, 633, 635, 637, 639, 641, 643, 645, 647, 649, 650, 651, 652, 653, 654, 655, 656, 657, 658, 660, 662, 664, 666, 668, 669, 670, 671, 672, 673, 674, 675, 676, 677, 679, 681, 683, 685, 686, 687, 689, 691, 693, 695, 696, 698, 699, 701, 702, 703, 704, 705, 706, 707, 709, 710, 711, 712, 713, 714, 715, 716, 717, 718, 719, 721, 722, 723, 724, 725, 726, 727, 728, 729, 730, 731, 732, 733, 734, 735, 736, 737, 738, 739, 740, 742, 744, 745, 746, 747, 749, 750, 752, 753, 754, 755, 757, 759, 760, 761, 762, 764, 765, 766, 767, 768, 769, 770, 771, and 772.

In some embodiments, the exogenous nucleic acid includes a regulatory region operably linked to a nucleotide sequence having 90 percent or greater sequence identity to the nucleotide sequence set forth in SEQ ID NOs: 1, 6, 16, 18, 21, 23, 25, 27, 30, 34, 37, 39, 46, 51, 53, 60, 62, 68, 71, 74, 76, 80, 92, 95, 101, 112, 114, 116, 118, 123, 128, 130, 133, 135, 139, 141, 143, 145, 157, 161, 165, 168, 170, 189, 196, 204, 206, 208, 210, 222, 226, 236, 238, 240, 242, 244, 247, 249, 252, 254, 256, 260, 262, 264, 266, 268, 270, 272, 275, 277, 279, 282, 286, 289, 291, 295, 297, 299, 301, 303, 305, 307, 309, 311, 313, 315, 317, 319, 321, 323, 325, 327, 330, 332, 334, 336, 340, 352, 354, 356, 359, 361, 363, 365, 367, 370, 372, 374, 381, 383, 385, 387, 389, 391, 394, 403, 406, 408, 410, 412, 415, 417, 419, 422, 427, 430, 448, 450, 452, 455, 464, 466, 477, 479, 481, 483, 485, 487, 489, 491, 493, 495, 497, 499, 501, 503, 505, 507, 509, 511, 513, 515, 517, 519, 521, 523, 525, 527, 529, 531, 533, 536, 538, 541, 543, 546, 548, 550, 552, 554, 556, 559, 561, 563, 567, 569, 571, 573, 575, 577, 582, 584, 586, 588, 590, 592, 594, 596, 598, 600, 602, 604, 606, 609, 611, 613, 615, 617, 619, 621, 623, 626, 628, 630, 632, 634, 636, 638, 640, 642, 644, 646, 648, 659, 661, 663, 665, 667, 678, 680, 682, 684, 688, 690, 692, 694, 697, 700, 708, 720, 741, 743, 748, 751, 756, 758, and 763.

In any of the methods described herein, the nucleotide sequence can encode a polypeptide having 95 percent or greater sequence identity to the amino acid sequence set forth in SEQ ID NOs: 2, 3, 4, 5, 7, 8, 9, 10, 11, 12, 13, 14, 15, 17, 19, 20, 22, 24, 26, 28, 29, 31, 32, 33, 35, 36, 38, 40, 41, 42, 43, 44, 45, 47, 48, 49, 50, 52, 54, 55, 56, 57, 58, 59, 61, 63, 64, 65, 66, 67, 69, 70, 72, 73, 75, 77, 78, 79, 81, 82, 83, 84, 85, 86, 87, 88, 89, 90, 91, 93, 94, 96, 97, 98, 99, 100, 102, 103, 104, 105, 106, 107, 108, 109, 110, 111, 113, 115, 117, 119, 120, 121, 122, 124, 125, 126, 127, 129, 131, 132, 134, 136, 137, 138, 140, 142, 144, 146, 147, 148, 149, 150, 151, 152, 153, 154, 155, 156, 158, 159, 160, 162, 163, 164, 166, 167, 169, 171, 172, 173, 174, 175, 176, 177, 178, 179, 180, 181, 182, 183, 184, 185, 186, 187, 188, 190, 191, 192, 193, 194, 195, 197, 198, 199, 200, 201, 202, 203, 205, 207, 209, 211, 212, 213, 214, 215, 216, 217, 218, 219, 220, 221, 223, 224, 225, 227, 228, 229, 230, 231, 232, 233, 234, 235, 237, 239, 241, 243, 245, 246, 248, 250, 251, 253, 255, 257, 258, 259, 261, 263, 265, 267, 269, 271, 273, 274, 276, 278, 280, 281, 283, 284, 285, 287, 288, 290, 292, 293, 294, 296, 298, 300, 302, 304, 306, 308, 310, 312, 314, 316, 318, 320, 322, 324, 326, 328, 329, 331, 333, 335, 337, 338, 339, 341, 342, 343, 344, 345, 346, 347, 348, 349, 350, 351, 353, 355, 357, 358, 360, 362, 364, 366, 368, 369, 371, 373, 375, 376, 377, 378, 379, 380, 382, 384, 386, 388, 390, 392, 393, 395, 396, 397, 398, 399, 400, 401, 402, 404, 405, 407, 409, 411, 413, 414, 416, 418, 420, 421, 423, 424, 425, 426, 428, 429, 431, 432, 433, 434, 435, 436, 437, 438, 439, 440, 441, 442, 443, 444, 445, 446, 447, 449, 451, 453, 454, 456, 457, 458, 459, 460, 461, 462, 463, 465, 467, 468, 469, 470, 471, 472, 473, 474, 475, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 535, 537, 539, 540, 542, 544, 545, 547, 549, 551, 553, 555, 557, 558, 560, 562, 564, 568, 570, 572, 574, 576, 578, 579, 580, 581, 583, 585, 587, 589, 591, 593, 595, 597, 599, 601, 603, 605, 607, 608, 610, 612, 614, 616, 618, 620, 622, 624, 625, 627, 629, 631, 633, 635, 637, 639, 641, 643, 645, 647, 649, 650, 651, 652, 653, 654, 655, 656, 657, 658, 660, 662, 664, 666, 668, 669, 670, 671, 672, 673, 674, 675, 676, 677, 679, 681, 683, 685, 686, 687, 689, 691, 693, 695, 696, 698, 699, 701, 702, 703, 704, 705, 706, 707, 709, 710, 711, 712, 713, 714, 715, 716, 717, 718, 719, 721, 722, 723, 724, 725, 726, 727, 728, 729, 730, 731, 732, 733, 734, 735, 736, 737, 738, 739, 740, 742, 744, 745, 746, 747, 749, 750, 752, 753, 754, 755, 757, 759, 760, 761, 762, 764, 765, 766, 767, 768, 769, 770, 771, and 772.

In any of the methods described herein, the nucleotide sequence can encode a polypeptide having 98 percent or greater sequence identity to the amino acid sequence set forth in SEQ ID NOs: 2, 3, 4, 5, 7, 8, 9, 10, 11, 12, 13, 14, 15, 17, 19, 20, 22, 24, 26, 28, 29, 31, 32, 33, 35, 36, 38, 40, 41, 42, 43, 44, 45, 47, 48, 49, 50, 52, 54, 55, 56, 57, 58, 59, 61, 63, 64, 65, 66, 67, 69, 70, 72, 73, 75, 77, 78, 79, 81, 82, 83, 84, 85, 86, 87, 88, 89, 90, 91, 93, 94, 96, 97, 98, 99, 100, 102, 103, 104, 105, 106, 107, 108, 109, 110, 111, 113, 115, 117, 119, 120, 121, 122, 124, 125, 126, 127, 129, 131, 132, 134, 136, 137, 138, 140, 142, 144, 146, 147, 148, 149, 150, 151, 152, 153, 154, 155, 156, 158, 159, 160, 162, 163, 164, 166, 167, 169, 171, 172, 173, 174, 175, 176, 177, 178, 179, 180, 181, 182, 183, 184, 185, 186, 187, 188, 190, 191, 192, 193, 194, 195, 197, 198, 199, 200, 201, 202, 203, 205, 207, 209, 211, 212, 213, 214, 215, 216, 217, 218, 219, 220, 221, 223, 224, 225, 227, 228, 229, 230, 231, 232, 233, 234, 235, 237, 239, 241, 243, 245, 246, 248, 250, 251, 253, 255, 257, 258, 259, 261, 263, 265, 267, 269, 271, 273, 274, 276, 278, 280, 281, 283, 284, 285, 287, 288, 290, 292, 293, 294, 296, 298, 300, 302, 304, 306, 308, 310, 312, 314, 316, 318, 320, 322, 324, 326, 328, 329, 331, 333, 335, 337, 338, 339, 341, 342, 343, 344, 345, 346, 347, 348, 349, 350, 351, 353, 355, 357, 358, 360, 362, 364, 366, 368, 369, 371, 373, 375, 376, 377, 378, 379, 380, 382, 384, 386, 388, 390, 392, 393, 395, 396, 397, 398, 399, 400, 401, 402, 404, 405, 407, 409, 411, 413, 414, 416, 418, 420, 421, 423, 424, 425, 426, 428, 429, 431, 432, 433, 434, 435, 436, 437, 438, 439, 440, 441, 442, 443, 444, 445, 446, 447, 449, 451, 453, 454, 456, 457, 458, 459, 460, 461, 462, 463, 465, 467, 468, 469, 470, 471, 472, 473, 474, 475, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 535, 537, 539, 540, 542, 544, 545, 547, 549, 551, 553, 555, 557, 558, 560, 562, 564, 568, 570, 572, 574, 576, 578, 579, 580, 581, 583, 585, 587, 589, 591, 593, 595, 597, 599, 601, 603, 605, 607, 608, 610, 612, 614, 616, 618, 620, 622, 624, 625, 627, 629, 631, 633, 635, 637, 639, 641, 643, 645, 647, 649, 650, 651, 652, 653, 654, 655, 656, 657, 658, 660, 662, 664, 666, 668, 669, 670, 671, 672, 673, 674, 675, 676, 677, 679, 681, 683, 685, 686, 687, 689, 691, 693, 695, 696, 698, 699, 701, 702, 703, 704, 705, 706, 707, 709, 710, 711, 712, 713, 714, 715, 716, 717, 718, 719, 721, 722, 723, 724, 725, 726, 727, 728, 729, 730, 731, 732, 733, 734, 735, 736, 737, 738, 739, 740, 742, 744, 745, 746, 747, 749, 750, 752, 753, 754, 755, 757, 759, 760, 761, 762, 764, 765, 766, 767, 768, 769, 770, 771, and 772.

In any of the methods described herein, the nucleotide sequence can have 95 percent or greater (e.g., 98 percent or 99 percent or greater) sequence identity to the nucleotide sequence set forth in SEQ ID NOs: 1, 6, 16, 18, 21, 23, 25, 27, 30, 34, 37, 39, 46, 51, 53, 60, 62, 68, 71, 74, 76, 80, 92, 95, 101, 112, 114, 116, 118, 123, 128, 130, 133, 135, 139, 141, 143, 145, 157, 161, 165, 168, 170, 189, 196, 204, 206, 208, 210, 222, 226, 236, 238, 240, 242, 244, 247, 249, 252, 254, 256, 260, 262, 264, 266, 268, 270, 272, 275, 277, 279, 282, 286, 289, 291, 295, 297, 299, 301, 303, 305, 307, 309, 311, 313, 315, 317, 319, 321, 323, 325, 327, 330, 332, 334, 336, 340, 352, 354, 356, 359, 361, 363, 365, 367, 370, 372, 374, 381, 383, 385, 387, 389, 391, 394, 403, 406, 408, 410, 412, 415, 417, 419, 422, 427, 430, 448, 450, 452, 455, 464, 466, 477, 479, 481, 483, 485, 487, 489, 491, 493, 495, 497, 499, 501, 503, 505, 507, 509, 511, 513, 515, 517, 519, 521, 523, 525, 527, 529, 531, 533, 536, 538, 541, 543, 546, 548, 550, 552, 554, 556, 559, 561, 563, 567, 569, 571, 573, 575, 577, 582, 584, 586, 588, 590, 592, 594, 596, 598, 600, 602, 604, 606, 609, 611, 613, 615, 617, 619, 621, 623, 626, 628, 630, 632, 634, 636, 638, 640, 642, 644, 646, 648, 659, 661, 663, 665, 667, 678, 680, 682, 684, 688, 690, 692, 694, 697, 700, 708, 720, 741, 743, 748, 751, 756, 758, and 763.

In any of the methods described herein, the nucleotide sequence can encode the polypeptide set forth in SEQ ID NOs: 2, 3, 4, 5, 7, 8, 9, 10, 11, 12, 13, 14, 15, 17, 19, 20, 22, 24, 26, 28, 29, 31, 32, 33, 35, 36, 38, 40, 41, 42, 43, 44, 45, 47, 48, 49, 50, 52, 54, 55, 56, 57, 58, 59, 61, 63, 64, 65, 66, 67, 69, 70, 72, 73, 75, 77, 78, 79, 81, 82, 83, 84, 85, 86, 87, 88, 89, 90, 91, 93, 94, 96, 97, 98, 99, 100, 102, 103, 104, 105, 106, 107, 108, 109, 110, 111, 113, 115, 117, 119, 120, 121, 122, 124, 125, 126, 127, 129, 131, 132, 134, 136, 137, 138, 140, 142, 144, 146, 147, 148, 149, 150, 151, 152, 153, 154, 155, 156, 158, 159, 160, 162, 163, 164, 166, 167, 169, 171, 172, 173, 174, 175, 176, 177, 178, 179, 180, 181, 182, 183, 184, 185, 186, 187, 188, 190, 191, 192, 193, 194, 195, 197, 198, 199, 200, 201, 202, 203, 205, 207, 209, 211, 212, 213, 214, 215, 216, 217, 218, 219, 220, 221, 223, 224, 225, 227, 228, 229, 230, 231, 232, 233, 234, 235, 237, 239, 241, 243, 245, 246, 248, 250, 251, 253, 255, 257, 258, 259, 261, 263, 265, 267, 269, 271, 273, 274, 276, 278, 280, 281, 283, 284, 285, 287, 288, 290, 292, 293, 294, 296, 298, 300, 302, 304, 306, 308, 310, 312, 314, 316, 318, 320, 322, 324, 326, 328, 329, 331, 333, 335, 337, 338, 339, 341, 342, 343, 344, 345, 346, 347, 348, 349, 350, 351, 353, 355, 357, 358, 360, 362, 364, 366, 368, 369, 371, 373, 375, 376, 377, 378, 379, 380, 382, 384, 386, 388, 390, 392, 393, 395, 396, 397, 398, 399, 400, 401, 402, 404, 405, 407, 409, 411, 413, 414, 416, 418, 420, 421, 423, 424, 425, 426, 428, 429, 431, 432, 433, 434, 435, 436, 437, 438, 439, 440, 441, 442, 443, 444, 445, 446, 447, 449, 451, 453, 454, 456, 457, 458, 459, 460, 461, 462, 463, 465, 467, 468, 469, 470, 471, 472, 473, 474, 475, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 535, 537, 539, 540, 542, 544, 545, 547, 549, 551, 553, 555, 557, 558, 560, 562, 564, 568, 570, 572, 574, 576, 578, 579, 580, 581, 583, 585, 587, 589, 591, 593, 595, 597, 599, 601, 603, 605, 607, 608, 610, 612, 614, 616, 618, 620, 622, 624, 625, 627, 629, 631, 633, 635, 637, 639, 641, 643, 645, 647, 649, 650, 651, 652, 653, 654, 655, 656, 657, 658, 660, 662, 664, 666, 668, 669, 670, 671, 672, 673, 674, 675, 676, 677, 679, 681, 683, 685, 686, 687, 689, 691, 693, 695, 696, 698, 699, 701, 702, 703, 704, 705, 706, 707, 709, 710, 711, 712, 713, 714, 715, 716, 717, 718, 719, 721, 722, 723, 724, 725, 726, 727, 728, 729, 730, 731, 732, 733, 734, 735, 736, 737, 738, 739, 740, 742, 744, 745, 746, 747, 749, 750, 752, 753, 754, 755, 757, 759, 760, 761, 762, 764, 765, 766, 767, 768, 769, 770, 771, and 772.

In any of the methods described herein, the method further can include harvesting biomass from the plant.

In any of the methods described herein, the regulatory region can be a promoter. For example, the promoter can be selected from the group consisting of YP0092, PT0676, PT0708, PT0613, PT0672, PT0678, PT0688, PT0837, the napin promoter, the Arcelin-5 promoter, the phaseolin gene promoter, the soybean trypsin inhibitor promoter, the ACP promoter, the stearoyl-ACP desaturase gene promoter, the soybean a' subunit of β-conglycinin promoter, the oleosin promoter, the 15 kD zein promoter, the 16 kD zein promoter, the 19 kD zein promoter, the 22 kD zein promoter, the 27 kD zein promoter, the Osgt-1 promoter, the beta-amylase gene promoter, the barley hordein gene promoter, p326, YP0144, YP190, p13879, YP0050, p32449, 21876, YP0158, YP0214, YP0380, PT0848, PT0633, the cauliflower mosaic virus (CaMV) $^{35}$S promoter, the mannopine synthase (MAS) promoter, the 1' or 2' promoters derived from T-DNA of Agrobacterium tumefaciens, the figwort mosaic virus 34S promoter, rice actin promoter, maize ubiquitin-1 promoter, ribulose-1,5-bisphosphate carboxylase (RbcS) promoter, the pine cab6 promoter, the Cab-1 gene promoter from wheat, the CAB-1 promoter from spinach, the cab1R promoter from rice, the pyruvate orthophosphate dikinase (PPDK) promoter from corn, the tobacco Lhcb1*2 promoter, the Arabidopsis thaliana SUC2 sucrose-H+ symporter promoter, and a thylakoid membrane protein promoter from spinach, and PT0585.

In any of the methods described herein, the plant containing the exogenous nucleic acid can have an improved growth rate relative to a corresponding plant that does not contain the nucleic acid.

In any of the methods described herein, the plant containing the exogenous nucleic acid can have improved vegetative growth relative to a corresponding plant that does not contain nucleic acid.

This document also features a method of increasing tolerance of a plant to elevated levels of aluminum. The method includes introducing into a plurality of plant cells an isolated nucleic acid comprising a nucleic acid sequence encoding a polypeptide having 90 percent or greater sequence identity to an amino acid sequence set forth in SEQ ID NOs: 2, 3, 4, 5, 7, 8, 9, 10, 11, 12, 13, 14, 15, 17, 19, 20, 22, 24, 26, 28, 29, 31, 32, 33, 35, 36, 38, 40, 41, 42, 43, 44, 45, 47, 48, 49, 50, 52, 54, 55, 56, 57, 58, 59, 61, 63, 64, 65, 66, 67, 69, 70, 72, 73, 75, 77, 78, 79, 81, 82, 83, 84, 85, 86, 87, 88, 89, 90, 91, 93, 94, 96, 97, 98, 99, 100, 102, 103, 104, 105, 106, 107, 108, 109, 110, 111, 113, 115, 117, 119, 120, 121, 122, 124, 125, 126, 127, 129, 131, 132, 134, 136, 137, 138, 140, 142, 144, 146, 147, 148, 149, 150, 151, 152, 153, 154, 155, 156, 158, 159, 160, 162, 163, 164, 166, 167, 169, 171, 172, 173, 174, 175, 176, 177, 178, 179, 180, 181, 182, 183, 184, 185, 186, 187, 188, 190, 191, 192, 193, 194, 195, 197, 198, 199, 200, 201, 202, 203, 205, 207, 209, 211, 212, 213, 214, 215, 216, 217, 218, 219, 220, 221, 223, 224, 225, 227, 228, 229, 230, 231, 232, 233, 234, 235, 237, 239, 241, 243, 245, 246, 248, 250, 251, 253, 255, 257, 258, 259, 261, 263, 265, 267, 269, 271, 273, 274, 276, 278, 280, 281, 283, 284, 285, 287, 288, 290, 292, 293, 294, 296, 298, 300, 302, 304, 306, 308, 310, 312, 314, 316, 318, 320, 322, 324, 326, 328, 329, 331, 333, 335, 337, 338, 339, 341, 342, 343, 344, 345, 346, 347, 348, 349, 350, 351, 353, 355, 357, 358, 360, 362, 364, 366, 368, 369, 371, 373, 375, 376, 377, 378, 379, 380, 382, 384, 386, 388, 390, 392, 393, 395, 396, 397, 398, 399, 400, 401, 402, 404, 405, 407, 409, 411, 413, 414, 416, 418, 420, 421, 423, 424, 425, 426, 428, 429, 431, 432, 433, 434, 435, 436, 437, 438, 439, 440, 441, 442, 443, 444, 445, 446, 447, 449, 451, 453, 454, 456, 457, 458, 459, 460, 461, 462, 463, 465, 467, 468, 469, 470, 471, 472, 473, 474, 475, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 535, 537, 539, 540, 542, 544, 545, 547, 549, 551, 553, 555, 557, 558, 560, 562, 564, 568, 570, 572, 574, 576, 578, 579, 580, 581, 583, 585, 587, 589, 591, 593, 595, 597, 599, 601, 603, 605, 607, 608, 610, 612, 614, 616, 618, 620, 622, 624, 625, 627, 629, 631, 633, 635, 637, 639, 641, 643, 645, 647, 649, 650, 651, 652, 653, 654, 655, 656, 657, 658, 660, 662, 664, 666, 668, 669, 670, 671, 672, 673, 674, 675, 676, 677, 679, 681, 683, 685, 686, 687, 689, 691, 693, 695, 696, 698, 699, 701, 702, 703, 704, 705, 706, 707, 709, 710, 711, 712, 713, 714, 715, 716, 717, 718, 719, 721, 722, 723, 724, 725, 726, 727, 728, 729, 730, 731, 732, 733, 734, 735, 736, 737, 738, 739, 740, 742, 744, 745, 746, 747, 749, 750, 752, 753, 754, 755, 757, 759, 760, 761, 762, 764, 765, 766, 767, 768, 769, 770, 771, and 772; producing a plant from the plant cell; and growing the plant on soil having an elevated level of $Al^{3+}$, wherein the plant has increased yield as compared to that of a control plant that does not comprise the nucleic acid. The nucleic acid sequence encoding the polypeptide can be operably linked to a regulatory region.

This document also features a method of increasing tolerance of a plant to elevated levels of aluminum. The method includes introducing into a plurality of plant cells an isolated nucleic acid comprising a nucleic acid sequence encoding a polypeptide having 90 percent or greater sequence identity to an amino acid sequence set forth in SEQ ID NOs: 2, 3, 4, 5, 7, 8, 9, 10, 11, 12, 13, 14, 15, 17, 19, 20, 22, 24, 26, 28, 29, 31, 32, 33, 35, 36, 38, 40, 41, 42, 43, 44, 45, 47, 48, 49, 50, 52, 54, 55, 56, 57, 58, 59, 61, 63, 64, 65, 66, 67, 69, 70, 72, 73, 75, 77, 78, 79, 81, 82, 83, 84, 85, 86, 87, 88, 89, 90, 91, 93, 94, 96, 97, 98, 99, 100, 102, 103, 104, 105, 106, 107, 108, 109, 110, 111, 113, 115, 117, 119, 120, 121, 122, 124, 125, 126, 127, 129, 131, 132, 134, 136, 137, 138, 140, 142, 144, 146, 147, 148, 149, 150, 151, 152, 153, 154, 155, 156, 158, 159, 160, 162, 163, 164, 166, 167, 169, 171, 172, 173, 174, 175, 176, 177, 178, 179, 180, 181, 182, 183, 184, 185, 186, 187, 188, 190, 191, 192, 193, 194, 195, 197, 198, 199, 200, 201, 202, 203, 205, 207, 209, 211, 212, 213, 214, 215, 216, 217, 218, 219, 220, 221, 223, 224, 225, 227, 228, 229, 230, 231, 232, 233, 234, 235, 237, 239, 241, 243, 245, 246, 248, 250, 251, 253, 255, 257, 258, 259, 261, 263, 265, 267, 269, 271, 273, 274, 276, 278, 280, 281, 283, 284, 285, 287, 288, 290, 292, 293, 294, 296, 298, 300, 302, 304, 306, 308, 310, 312, 314, 316, 318, 320, 322, 324, 326, 328, 329, 331, 333, 335, 337, 338, 339, 341, 342, 343, 344, 345, 346, 347, 348, 349, 350, 351, 353, 355, 357, 358, 360, 362, 364, 366, 368, 369, 371, 373, 375, 376, 377, 378, 379, 380, 382, 384, 386, 388, 390, 392, 393, 395, 396, 397, 398, 399, 400, 401, 402, 404, 405, 407, 409, 411, 413, 414, 416, 418, 420, 421, 423, 424, 425, 426, 428, 429, 431, 432, 433, 434, 435, 436, 437, 438, 439, 440, 441, 442, 443, 444, 445, 446, 447, 449, 451, 453, 454, 456, 457, 458, 459, 460, 461, 462, 463, 465, 467, 468, 469, 470, 471, 472, 473, 474, 475, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 535, 537, 539, 540, 542, 544, 545, 547, 549, 551, 553, 555, 557, 558, 560, 562, 564, 568, 570, 572, 574, 576, 578, 579, 580, 581, 583, 585, 587, 589, 591, 593, 595, 597, 599, 601, 603, 605, 607, 608, 610, 612, 614, 616, 618, 620, 622, 624, 625, 627, 629, 631, 633, 635, 637, 639, 641, 643, 645, 647, 649, 650, 651, 652, 653, 654, 655, 656, 657, 658, 660, 662, 664, 666, 668, 669, 670, 671, 672, 673, 674, 675, 676, 677, 679, 681, 683, 685, 686, 687, 689, 691, 693, 695, 696, 698, 699, 701, 702, 703, 704, 705, 706, 707, 709, 710, 711, 712, 713, 714, 715, 716, 717, 718, 719, 721, 722, 723, 724, 725, 726, 727, 728, 729, 730, 731, 732, 733, 734, 735, 736, 737, 738, 739, 740, 742, 744, 745, 746, 747, 749, 750, 752, 753, 754, 755, 757, 759, 760, 761, 762, 764, 765, 766, 767, 768, 769, 770, 771, and 772; and selecting a plant produced from the plurality of plant cells that has an increased tolerance to elevated $Al^{3+}$ as compared to the tolerance in a corresponding control plant that does not comprise the isolated nucleic acid. The nucleic acid sequence encoding the polypeptide can be operably linked to a regulatory region.

This document also features a plant cell that contains an exogenous nucleic acid, the exogenous nucleic acid comprising a regulatory region operably linked to a nucleotide sequence encoding a polypeptide, wherein the HMM bit score of the amino acid sequence of the polypeptide is greater than about 65, the HMM based on the amino acid sequence depicted in any one of FIGS. 1-4, and wherein a plant produced from the plant cell is tolerant of elevated soil levels of $Al^{3+}$ as compared to that of a control plant that does not comprise the nucleic acid, and wherein the plant is not tolerant of elevated saline levels.

This document also features a plant cell that contains an exogenous nucleic acid, the exogenous nucleic acid comprising a regulatory region operably linked to a nucleotide sequence encoding a polypeptide having 90 percent or greater sequence identity to an amino acid sequence set forth in SEQ ID NOs: 2, 3, 4, 5, 7, 8, 9, 10, 11, 12, 13, 14, 15, 17, 19, 20, 22, 24, 26, 28, 29, 31, 32, 33, 35, 36, 38, 40, 41, 42, 43, 44, 45, 47, 48, 49, 50, 52, 54, 55, 56, 57, 58, 59, 61, 63, 64, 65, 66, 67, 69, 70, 72, 73, 75, 77, 78, 79, 81, 82, 83, 84, 85, 86, 87, 88, 89, 90, 91, 93, 94, 96, 97, 98, 99, 100, 102, 103, 104, 105, 106, 107, 108, 109, 110, 111, 113, 115, 117, 119, 120, 121, 122, 124, 125, 126, 127, 129, 131, 132, 134, 136, 137, 138, 140, 142, 144, 146, 147, 148, 149, 150, 151, 152, 153, 154, 155, 156, 158, 159, 160, 162, 163, 164, 166, 167, 169, 171, 172, 173, 174, 175, 176, 177, 178, 179, 180, 181, 182, 183, 184, 185, 186, 187, 188, 190, 191, 192, 193, 194, 195, 197, 198, 199, 200, 201, 202, 203, 205, 207, 209, 211, 212, 213, 214, 215, 216, 217, 218, 219, 220, 221, 223, 224, 225, 227, 228, 229, 230, 231, 232, 233, 234, 235, 237, 239, 241, 243, 245, 246, 248, 250, 251, 253, 255, 257, 258, 259, 261, 263, 265, 267, 269, 271, 273, 274, 276, 278, 280, 281, 283, 284, 285, 287, 288, 290, 292, 293, 294, 296, 298, 300, 302, 304, 306, 308, 310, 312, 314, 316, 318, 320, 322, 324, 326, 328, 329, 331, 333, 335, 337, 338, 339, 341, 342, 343, 344, 345, 346, 347, 348, 349, 350, 351, 353, 355, 357, 358, 360, 362, 364, 366, 368, 369, 371, 373, 375, 376, 377, 378, 379, 380, 382, 384, 386, 388, 390, 392, 393, 395, 396, 397, 398, 399, 400, 401, 402, 404, 405, 407, 409, 411, 413, 414, 416, 418, 420, 421, 423, 424, 425, 426, 428, 429, 431, 432, 433, 434, 435, 436, 437, 438, 439, 440, 441, 442, 443, 444, 445, 446, 447, 449, 451, 453, 454, 456, 457, 458, 459, 460, 461, 462, 463, 465, 467, 468, 469, 470, 471, 472, 473, 474, 475, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 535, 537, 539, 540, 542, 544, 545, 547, 549, 551, 553, 555, 557, 558, 560, 562, 564, 568, 570, 572, 574, 576, 578, 579, 580, 581, 583, 585, 587, 589, 591, 593, 595, 597, 599, 601, 603, 605, 607, 608, 610, 612, 614, 616, 618, 620, 622, 624, 625, 627, 629, 631, 633, 635, 637, 639, 641, 643, 645, 647, 649, 650, 651, 652, 653, 654, 655, 656, 657, 658, 660, 662, 664, 666, 668, 669, 670, 671, 672, 673, 674, 675, 676, 677, 679, 681, 683, 685, 686, 687, 689, 691, 693, 695, 696, 698, 699, 701, 702, 703, 704, 705, 706, 707, 709, 710, 711, 712, 713, 714, 715, 716, 717, 718, 719, 721, 722, 723, 724, 725, 726, 727, 728, 729, 730, 731, 732, 733, 734, 735, 736, 737, 738, 739, 740, 742, 744, 745, 746, 747, 749, 750, 752, 753, 754, 755, 757, 759, 760, 761, 762, 764, 765, 766, 767, 768, 769, 770, 771, and 772, and wherein a plant produced from the plant cell is tolerant of elevated soil levels of $Al^{3+}$ as compared to that of a control plant that does not comprise the nucleic acid, and wherein the plant is not tolerant of elevated saline levels.

This document also features a transgenic plant comprising a plant cell described herein, progeny of the plants that have increased tolerance to elevated $Al^{3+}$ conditions as compared to that of a control plant that does not comprise the nucleic acid, and wherein the progeny is not tolerant of elevated saline levels, seeds of the transgenic plants, and vegetative tissue of the transgenic plants, as well as food and feed products that include the vegetative tissue. The plant can be selected from the group consisting of *Panicum virgatum, Sorghum bicolor, Miscanthus giganteus, Saccharum* sp., *Populus balsamifera, Zea mays, Glycine max, Brassica napus, Triticum aestivum, Gossypium hirsutum, Oryza sativa, Helianthus annuus, Medicago sativa, Beta vulgaris,* or *Pennisetum glaucum.*

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims. The word "comprising" in the claims may be replaced by "consisting essentially of" or with "consisting of," according to standard practice in patent law.

DESCRIPTION OF DRAWINGS

FIGS. 1A-1D contain an alignment of the amino acid sequence of CeresClone: 375578 (SEQ ID NO: 353) with homologous and/or orthologous amino acid sequences. In all the alignment figures shown herein, a dash in an aligned sequence represents a gap, i.e., a lack of an amino acid at that position. Identical amino acids or conserved amino acid substitutions among aligned sequences are identified by boxes. FIG. 1 and the other alignment figures provided herein were generated using the program MUSCLE version 3.52.

FIGS. 2A-2C contain an alignment of the amino acid sequence of CeresClone: 11684 (SEQ ID NO: 237) with homologous and/or orthologous amino acid sequences.

FIGS. 3A-3C contain an alignment of the amino acid sequence of CeresClone: 24255 (SEQ ID NO: 451) with homologous and/or orthologous amino acid sequences.

Figure 4B:
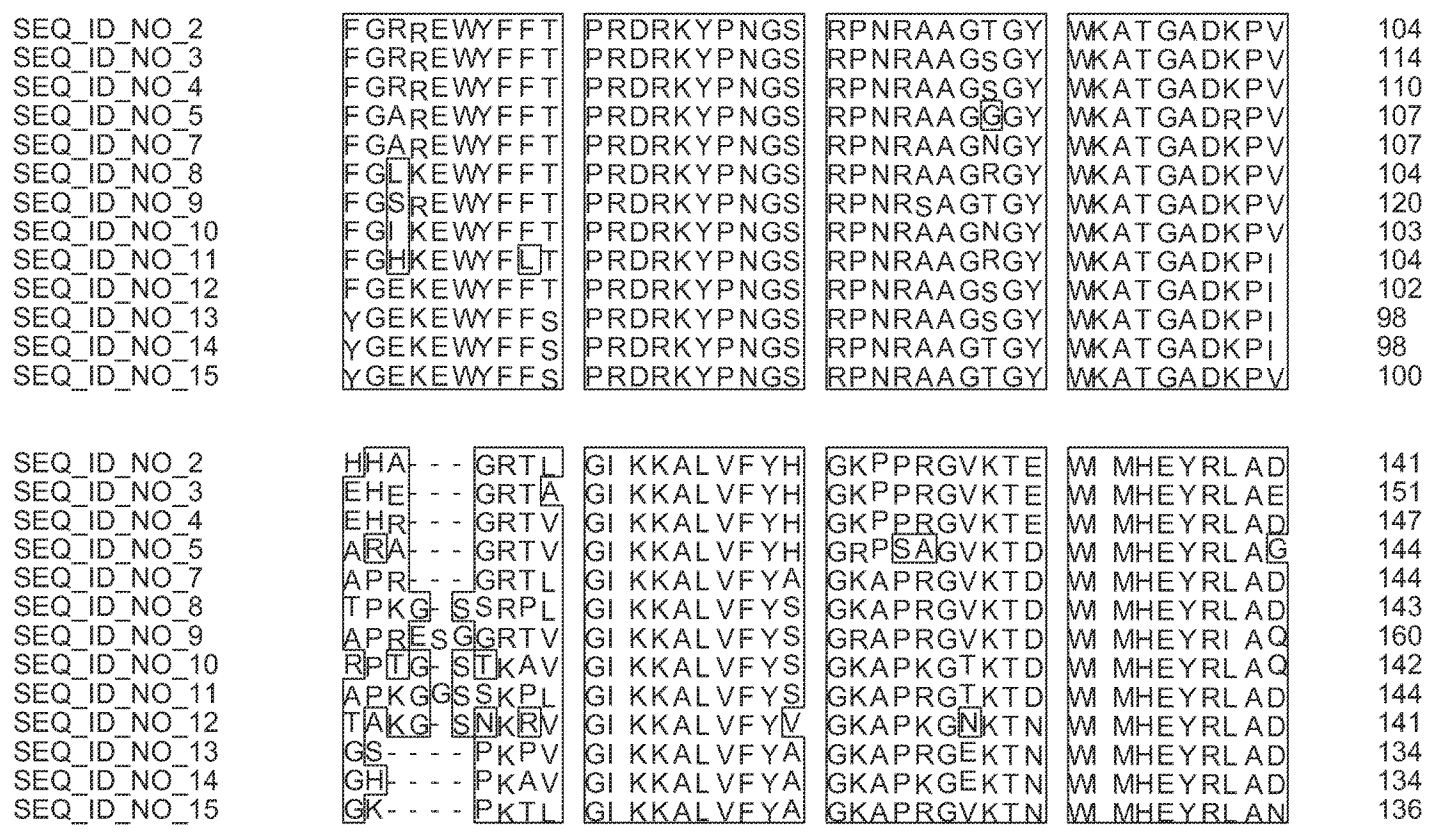
Figure 4C:
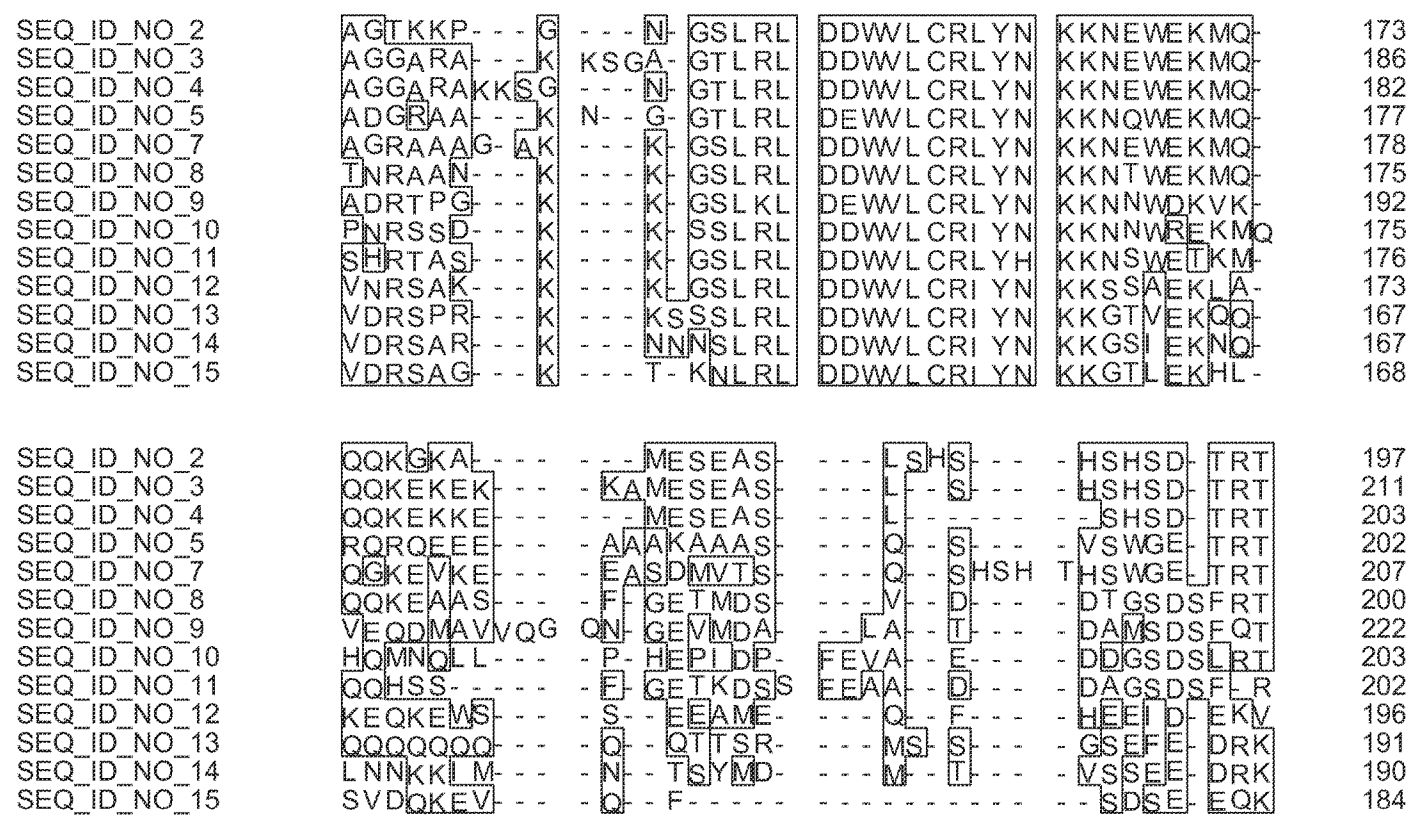
Figure 4D:
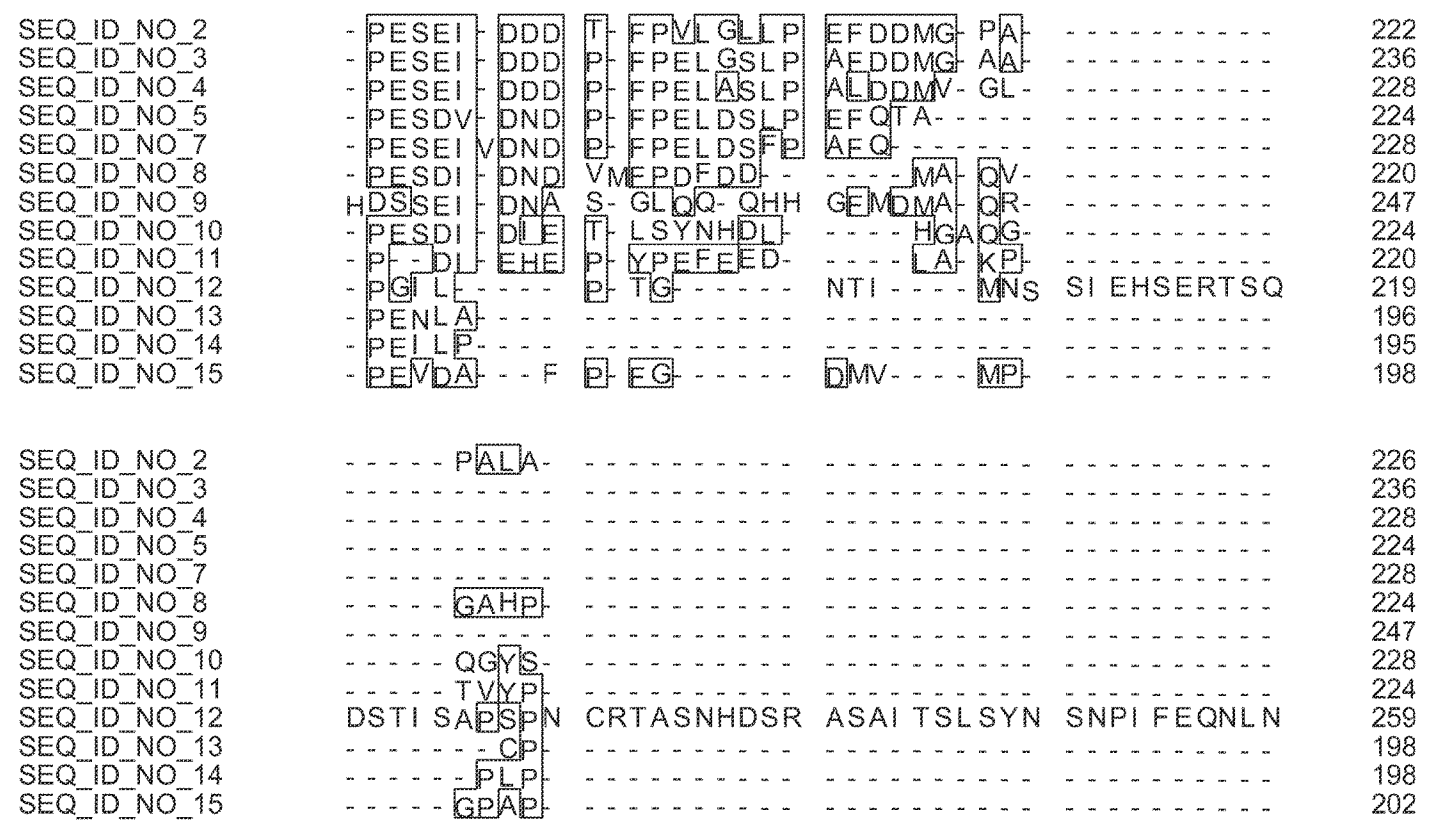
Figure 4E:
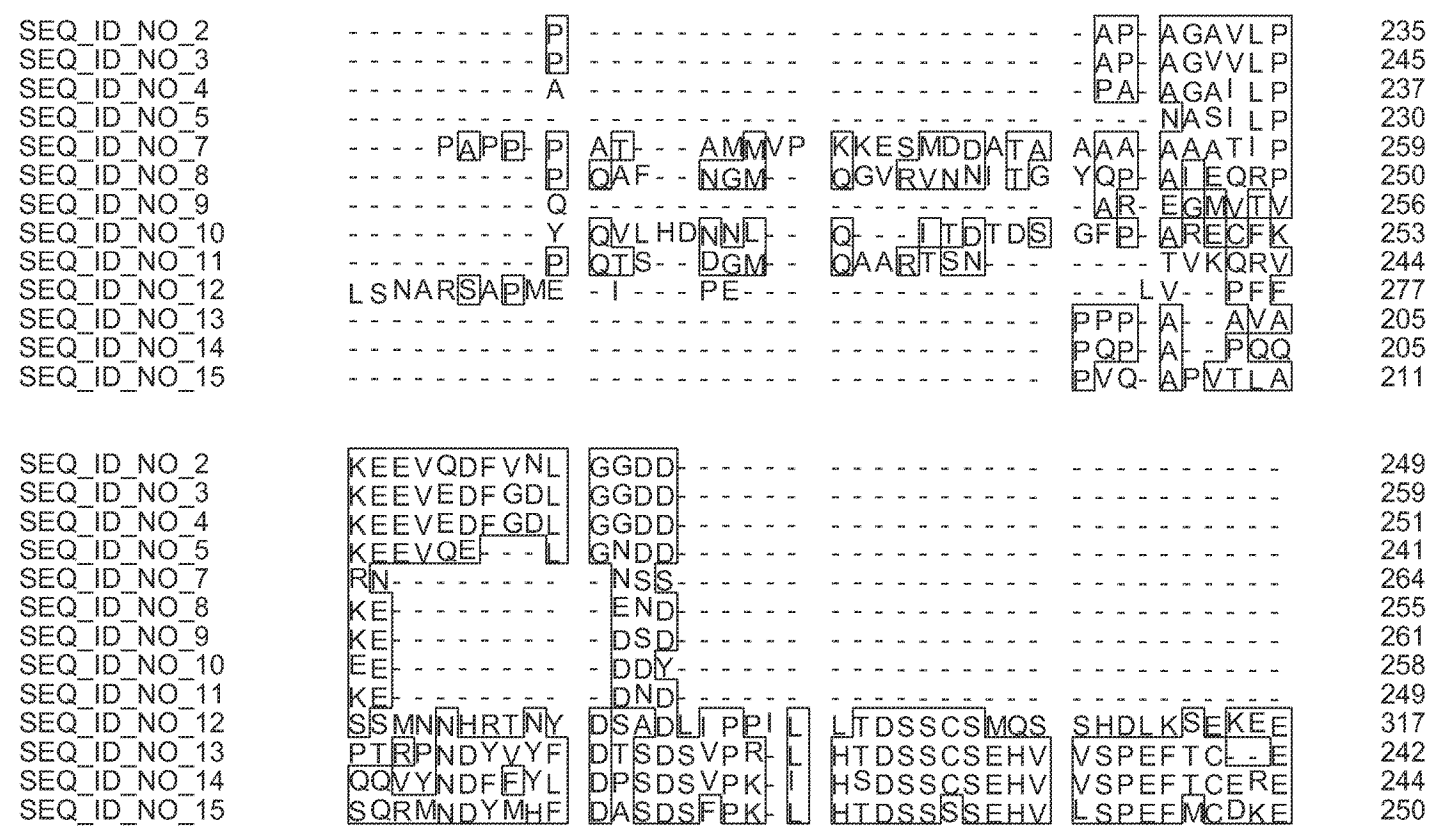
Figure 4F:
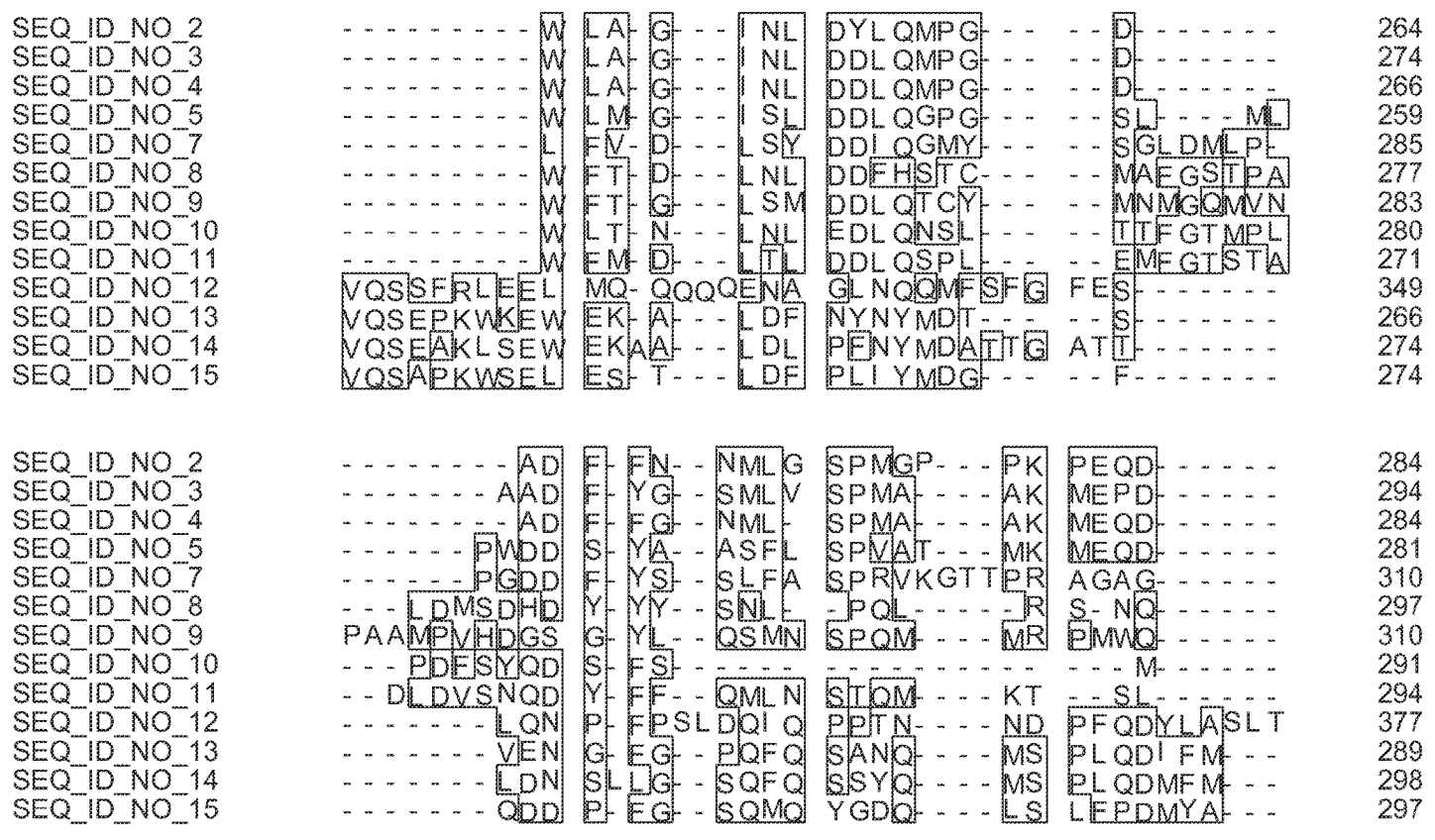

FIGS. 4A-4G contain an alignment of the amino acid sequence of CeresClone: 1752915 (SEQ ID NO: 2) with homologous and/or orthologous amino acid sequences.

DETAILED DESCRIPTION

Figure 5:
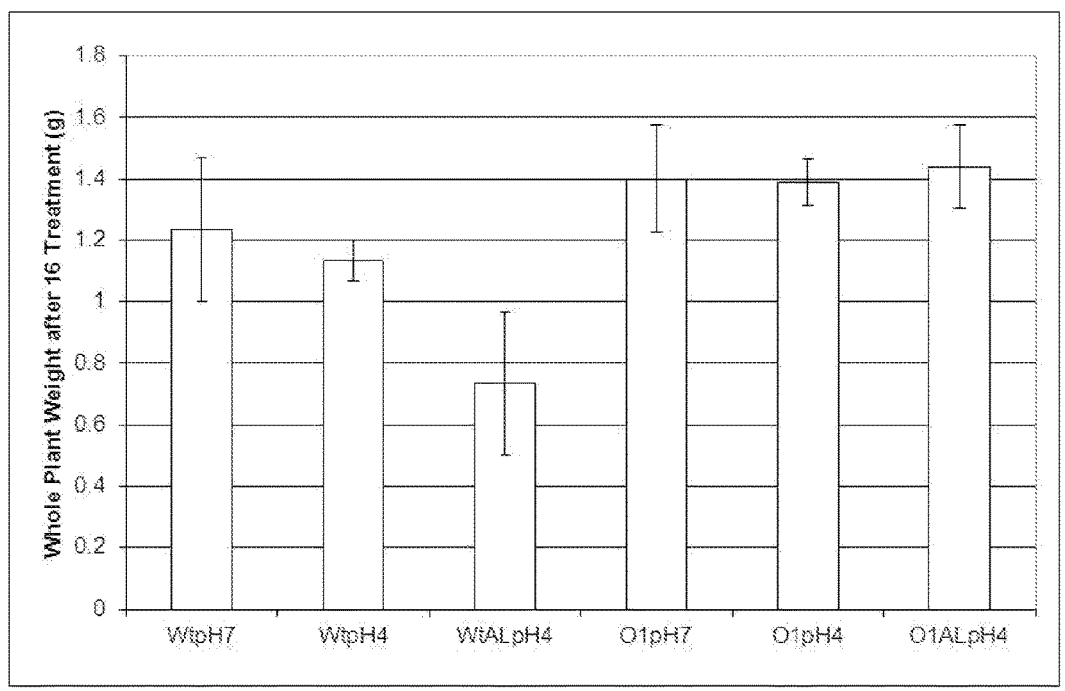
FIG. 5 is a bar graph of whole plant weight (shoots plus roots) of either wild-type (WT) controls or transgenic switchgrass (Ceres Clone 375578) treated with either pH 7.26 water (pH7); pH 4.0 water (pH4); or pH 4.0 water with aluminum (~11 g $AlCl_3$/Kg soil; ~0.00621 µM $Al^{+3}$) (AlpH4). Aluminum toxicity had little to no effect on plant weight of the transgenic plants in comparison to control.

The invention features methods and materials related to modulating aluminum tolerance in plants. In some embodiments, the plants may also have, for example, modulated levels of lignin, modified root architecture, modified herbicide resistance, modified carotenoid biosynthesis, or modulated cell wall content. The methods described herein can include transforming a plant cell with a nucleic acid encoding an aluminum tolerance-modulating polypeptide, wherein expression of the polypeptide results in a modulated level of aluminum tolerance. Plant cells produced using such methods can be grown to produce plants having an increased tolerance to elevated levels of aluminum. Such plants can have increased plant yield in soil containing elevated levels of $Al^{3+}$.

I. Definitions

"Amino acid" refers to one of the twenty biologically occurring amino acids and to synthetic amino acids, including D/L optical isomers.

"Cell type-preferential promoter" or "tissue-preferential promoter" refers to a promoter that drives expression preferentially in a target cell type or tissue, respectively, but may also lead to some transcription in other cell types or tissues as well.

"Control plant" refers to a plant that does not contain the exogenous nucleic acid present in a transgenic plant of interest, but otherwise has the same or similar genetic background as such a transgenic plant. A suitable control plant can be a non-transgenic wild type plant, a non-transgenic segregant from a transformation experiment, or a transgenic plant that contains an exogenous nucleic acid other than the exogenous nucleic acid of interest.

"Domains" are groups of substantially contiguous amino acids in a polypeptide that can be used to characterize protein families and/or parts of proteins. Such domains have a "fingerprint" or "signature" that can comprise conserved primary sequence, secondary structure, and/or three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

"Down-regulation" refers to regulation that decreases production of expression products (mRNA, polypeptide, or both) relative to basal or native states.

"Exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

"Expression" refers to the process of converting genetic information of a polynucleotide into RNA through transcription, which is catalyzed by an enzyme, RNA polymerase, and into protein, through translation of mRNA on ribosomes.

"Heterologous polypeptide" as used herein refers to a polypeptide that is not a naturally occurring polypeptide in a plant cell, e.g., a transgenic *Panicum* virgatum plant transformed with and expressing the coding sequence for a nitrogen transporter polypeptide from a *Zea mays* plant.

"Isolated nucleic acid" as used herein includes a naturally-occurring nucleic acid, provided one or both of the sequences immediately flanking that nucleic acid in its naturally-occurring genome is removed or absent. Thus, an isolated nucleic acid includes, without limitation, a nucleic acid that exists as a purified molecule or a nucleic acid molecule that is incorporated into a vector or a virus. A nucleic acid existing among hundreds to millions of other nucleic acids within, for example, cDNA libraries, genomic libraries, or gel slices containing a genomic DNA restriction digest, is not to be considered an isolated nucleic acid.

"Modulation" of the level of aluminum tolerance refers to the change in the level of the aluminum tolerance that is observed as a result of expression of, or transcription from, an exogenous nucleic acid in a plant cell and/or plant. The change in level is measured relative to the corresponding level in control plants. Aluminum tolerance can be assessed by measuring root growth and/or plant height of plants grown in acidified soils containing elevated levels of $Al^{3+}$. The concentration of $Al^{3+}$ considered to be elevated can be adjusted depending on the species being tested as plant species vary in their capacity to tolerate aluminum. For example, rice is more tolerant of aluminum than *sorghum*. As such, to determine increased tolerance to aluminum in rice, concentrations greater than 160 μM $Al^{3+}$ can be used. In *sorghum*, concentrations of around 27 μM $Al^{3+}$ can be used. For switchgrass, concentrations of around 600 μM can be used.

"Nucleic acid" and "polynucleotide" are used interchangeably herein, and refer to both RNA and DNA, including cDNA, genomic DNA, synthetic DNA, and DNA or RNA containing nucleic acid analogs. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, nucleic acid probes and nucleic acid primers. A polynucleotide may contain unconventional or modified nucleotides.

"Operably linked" refers to the positioning of a regulatory region and a sequence to be transcribed in a nucleic acid so that the regulatory region is effective for regulating transcription or translation of the sequence. For example, to operably link a coding sequence and a regulatory region, the translation initiation site of the translational reading frame of the coding sequence is typically positioned between one and about fifty nucleotides downstream of the regulatory region. A regulatory region can, however, be positioned as much as about 5,000 nucleotides upstream of the translation initiation site, or about 2,000 nucleotides upstream of the transcription start site.

"Polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. Full-length polypeptides, truncated polypeptides, point mutants, insertion mutants, splice variants, chimeric proteins, and fragments thereof are encompassed by this definition.

"Progeny" includes descendants of a particular plant or plant line. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. The designation $F_1$ refers to the progeny of a cross between two parents that are genetically distinct. The designations $F_2$, $F_3$, $F_4$, $F_5$ and $F_6$ refer to subsequent generations of self- or sib-pollinated progeny of an $F_1$ plant.

"Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., *The Plant Cell*, 1:977-984 (1989).

"Up-regulation" refers to regulation that increases the level of an expression product (mRNA, polypeptide, or both) relative to basal or native states.

"Vector" refers to a replicon, such as a plasmid, phage, or cosmid, into which another DNA segment may be inserted so as to bring about the replication of the inserted segment. Generally, a vector is capable of replication when associated with the proper control elements. The term "vector" includes cloning and expression vectors, as well as viral vectors and integrating vectors. An "expression vector" is a vector that includes a regulatory region.

II. Polypeptides

Polypeptides described herein include aluminum tolerance-modulating polypeptides. Aluminum tolerance-modulating polypeptides can be effective to modulate (e.g., increase) aluminum tolerance when expressed in a plant or plant cell. Such polypeptides typically contain at least one domain indicative of aluminum tolerance-modulating polypeptides, as described in more detail herein. Aluminum tolerance-modulating polypeptides typically have an HMM bit score that is greater than 65 as described in more detail herein. In some embodiments, aluminum tolerance-modulating polypeptides have greater than 80% identity to SEQ ID NOs: 2, 3, 4, 5, 7, 8, 9, 10, 11, 12, 13, 14, 15, 17, 19, 20, 22, 24, 26, 28, 29, 31, 32, 33, 35, 36, 38, 40, 41, 42, 43, 44, 45, 47, 48, 49, 50, 52, 54, 55, 56, 57, 58, 59, 61, 63, 64, 65, 66, 67, 69, 70, 72, 73, 75, 77, 78, 79, 81, 82, 83, 84, 85, 86, 87, 88, 89, 90, 91, 93, 94, 96, 97, 98, 99, 100, 102, 103, 104, 105, 106, 107, 108, 109, 110, 111, 113, 115, 117, 119, 120, 121, 122, 124, 125, 126, 127, 129, 131, 132, 134, 136, 137, 138, 140, 142, 144, 146, 147, 148, 149, 150, 151, 152, 153, 154, 155, 156, 158, 159, 160, 162, 163, 164, 166, 167, 169, 171, 172, 173, 174, 175, 176, 177, 178, 179, 180, 181, 182, 183, 184, 185, 186, 187, 188, 190, 191, 192, 193, 194, 195, 197, 198, 199, 200, 201, 202, 203, 205, 207, 209, 211, 212, 213, 214, 215, 216, 217, 218, 219, 220, 221, 223, 224, 225, 227, 228, 229, 230, 231, 232, 233, 234, 235, 237, 239, 241, 243, 245, 246, 248, 250, 251, 253, 255, 257, 258, 259, 261, 263, 265, 267, 269, 271, 273, 274, 276, 278, 280, 281, 283, 284, 285, 287, 288, 290, 292, 293, 294, 296, 298, 300, 302, 304, 306, 308, 310, 312, 314, 316, 318, 320, 322, 324, 326, 328, 329, 331, 333, 335, 337, 338, 339, 341, 342, 343, 344, 345, 346, 347, 348, 349, 350, 351, 353, 355, 357, 358, 360, 362, 364, 366, 368, 369, 371, 373, 375, 376, 377, 378, 379, 380, 382, 384, 386, 388, 390, 392, 393, 395, 396, 397, 398, 399, 400, 401, 402, 404, 405, 407, 409, 411, 413, 414, 416, 418, 420, 421, 423, 424, 425, 426, 428, 429, 431, 432, 433, 434, 435, 436, 437, 438, 439, 440, 441, 442, 443, 444, 445, 446, 447, 449, 451, 453, 454, 456, 457, 458, 459, 460, 461, 462, 463, 465, 467, 468, 469, 470, 471, 472, 473, 474, 475, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 535, 537, 539, 540, 542, 544, 545, 547, 549, 551, 553, 555, 557, 558, 560, 562, 564, 568, 570, 572, 574, 576, 578, 579, 580, 581, 583, 585, 587, 589, 591, 593, 595, 597, 599, 601, 603, 605, 607, 608, 610, 612, 614, 616, 618, 620, 622, 624, 625, 627, 629, 631, 633, 635, 637, 639, 641, 643, 645, 647, 649, 650, 651, 652, 653, 654, 655, 656, 657, 658, 660, 662, 664, 666, 668, 669, 670, 671, 672, 673, 674, 675, 676, 677, 679, 681, 683, 685, 686, 687, 689, 691, 693, 695, 696, 698, 699, 701, 702, 703, 704, 705, 706, 707, 709, 710, 711, 712, 713, 714, 715, 716, 717, 718, 719, 721, 722, 723, 724, 725, 726, 727, 728, 729, 730, 731, 732, 733, 734, 735, 736, 737, 738, 739, 740, 742, 744, 745, 746, 747, 749, 750, 752, 753, 754, 755, 757, 759, 760, 761, 762, 764, 765, 766, 767, 768, 769, 770, 771, or 772 as described in more detail herein.

A. Domains Indicative of Aluminum Tolerance-Modulating Polypeptides

An aluminum tolerance-modulating polypeptide can contain a NAC domain, which is predicted to be characteristic of an aluminum tolerance modulating polypeptide. SEQ ID NO: 2 sets forth the amino acid sequence of a *Panicum virgatum* clone, identified herein as CeresClone: 1752915 (SEQ ID NO:1), that is predicted to contain a NAC protein domain. For example, an aluminum tolerance-modulating polypeptide can comprise a NAC protein domain having 60 percent or greater (e.g., 65, 70, 75, 80, 85, 90, 95, 97, 98, 99, or 100%) sequence identity to residues 14 to 139 of SEQ ID NO: 2. In some embodiments, an aluminum tolerance-modulating polypeptide can comprise a NAC protein domain having 60 percent or greater (e.g., 65, 70, 75, 80, 85, 90, 95, 97, 98, 99, or 100%) sequence identity to the NAC protein domain of one or more of the polypeptides set forth in SEQ ID NOs: 3, 4, 5, 7, 8, 9, 10, 11, 12, 13, 14, 15, 17, 19, 20, 22, 24, 26, 28, 29, 31, 32, 33, 35, 36, 38, 40, 41, 42, 43, 44, 45, 47, 48, 49, 50, 52, 54, 55, 56, 57, 58, 59, 61, 63, 64, 65, 66, 67, 69, 70, 72, 73, 75, 77, 78, 79, 81, 82, 83, 84, 85, 86, 87, 88, 89, 90, 91, 93, 94, 96, 97, 98, 99, 100, 102, 103, 104, 105, 106, 107, 108, 109, 110, 111, 113, 115, 117, 119, 120, 121, 122, 124, 125, 126, 127, 129, 131, 132, 134, 136, 137, 138, 140, 142, 144, 146, 147, 148, 149, 150, 151, 152, 153, 154, 155, 156, 158, 159, 160, 162, 163, 164, 166, 167, 169, 171, 172, 173, 174, 175, 176, 177, 178, 179, 180, 181, 182, 183, 184, 185, 186, 187, 188, 190, 191, 192, 193, 194, 195, 197, 198, 199, 200, 201, 202, 203, 205, 207, 209, 211, 212, 213, 214, 215, 216, 217, 218, 219, 220, 221, 223, 224, 225, 227, 228, 229, 230, 231, 232, 233, 234, and 235. The NAC protein domains of such sequences are set forth in the Sequence Listing. The NAC domain (about 160 amino acids) was identified from the No apical meristem (NAM) protein domain, ATFL-2, and CUC2 (Cup-Shaped Cotyledon). See Ooka et al. 2003, DNA Res. 20: 239-247; Fang et al. 2008, Mol. Genet. Genomics 280: 547-563). The NAM protein domain is characteristic of plant development proteins. NAM proteins have a role in determining positions of meristems and primordial. Mutations in NAM result in the failure to develop a shoot apical meristem in *petunia* embryos. See, e.g., Souer, et al., Cell 85:159-170 (1996).

An aluminum tolerance-modulating polypeptide can contain an AN1-like Zinc finger domain and an A20-like zinc finger domain, which are predicted to be characteristic of an aluminum tolerance-modulating polypeptide. For example, SEQ ID NO: 237 sets forth the amino acid sequence of an *Arabidopsis thaliana* clone, identified herein as CeresClone: 11684 (SEQ ID NO: 236), that is predicted to contain AN1-like and A20-like zinc finger domains. For example, an aluminum tolerance-modulating polypeptide can comprise an AN1-like Zinc finger domain having 60 percent or greater (e.g., 65, 70, 75, 80, 85, 90, 95, 97, 98, 99, or 100%) sequence identity to residues 101 to 140 of SEQ ID NO: 237 and can comprise an A20-like Zinc finger domain having 60 percent or greater (e.g., 65, 70, 75, 80, 85, 90, 95, 97, 98, 99, or 100%) sequence identity to residues 25 to 47 of SEQ ID NO: 237. In some embodiments, an aluminum tolerance-modulating polypeptide can comprise an AN1-like Zinc finger domain and an A20-like zinc finger domain having 60 percent or greater (e.g., 65, 70, 75, 80, 85, 90, 95, 97, 98, 99, or 100%) sequence identity to the AN1-like and A20-like zinc finger domains of one or more of the polypeptides set forth in SEQ ID NOs: 239, 241, 243, 245, 246, 248, 250, 251, 253, 255, 257, 258, 259, 261, 263, 265, 267, 269, 271, 273, 274, 276, 278, 280, 281, 283, 284, 285, 287, 288, 290, 292, 293, 294, 296, 298, 300, 302, 304, 306, 308, 310, 312, 314, 316, 318, 320, 322, 324, 326, 328, 329, 331, 333, 335, 337, 338, 339, 341, 342, 343, 344, 345, 346, 347, 348, 349, 350, and 351. The AN1-like and A20-like zinc finger domains of such sequences are set forth in the Sequence Listing. The AN1-like zinc finger domain is a dimetal (zinc)-bound alpha/beta fold, with six conserved cysteines and two histidines that can coordinate 2 zinc atoms. The A20-like zinc finger domain can be a ubiquitin binding domain that mediates self-association. Stress-associated proteins (SAPs) can have an AN1-like zinc finger domain and an A20-like zinc finger domain. See, e.g., Vij and Tyag, Mol Genet Genomics, 276(6):565-75 (2006).

SEQ ID NO: 451 sets forth the amino acid sequence of an *Arabidopsis thaliana* clone, identified herein as CeresClone: 24255 (SEQ ID NO: 450), that also is predicted to contain AN1-like and A20-like zinc finger domains. For example, an aluminum tolerance-modulating polypeptide can comprise an AN1-like Zinc finger domain having 60 percent or greater (e.g., 65, 70, 75, 80, 85, 90, 95, 97, 98, 99, or 100%) sequence identity to residues 102 to 141 of SEQ ID NO: 451 and can comprise an A20-like Zinc finger domain having 60 percent or greater (e.g., 65, 70, 75, 80, 85, 90, 95, 97, 98, 99, or 100%) sequence identity to residues 14 to 36 of SEQ ID NO: 451. In some embodiments, an aluminum tolerance-modulating polypeptide can comprise an AN1-like Zinc finger domain and an A20-like zinc finger domain having 60 percent or greater (e.g., 65, 70, 75, 80, 85, 90, 95, 97, 98, 99, or 100%) sequence identity to the AN1-like and A20-like zinc finger domains of one or more of the polypeptides set forth in SEQ ID NOs: 453, 454, 456, 457, 458, 459, 460, 461, 462, 463, 465, 467, 468, 469, 470, 471, 472, 473, 474, 475, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 535, 537, 539, 540, 542, 544, 545, 547, 549, 551, 553, 555, 557, 558, 560, 562, 564, 568, 570, 572, 574, 576, 578, 579, 580, 581, 583, 585, 587, 589, 591, 593, 595, 597, 599, 601, 603, 605, 607, 608, 610, 612, 614, 616, 618, 620, 622, 624, 625, 627, 629, 631, 633, 635, 637, 639, 641, 643, 645, 647, 649, 650, 651, 652, 653, 654, 655, 656, 657, 658, 660, 662, 664, 666, 668, 669, 670, 671, 672, 673, 674, 675, 676, 677, 679, 681, 683, 685, 686, 687, 689, 691, 693, 695, 696, 698, 699, 701, 702, 703, 704, 705, 706, 707, 709, 710, 711, 712, 713, 714, 715, 716, 717, 718, 719, 721, 722, 723, 724, 725, 726, 727, 728, 729, 730, 731, 732, 733, 734, 735, 736, 737, 738, 739, 740, 742, 744, 745, 746, 747, 749, 750, 752, 753, 754, 755, 757, 759, 760, 761, 762, 764, 765, 766, 767, 768, 769, 770, 771, and 772.

An aluminum tolerance-modulating polypeptide can contain an IQ domain, which is predicted to be characteristic of an aluminum tolerance-modulating polypeptide. SEQ ID NO: 353 sets forth the amino acid sequence of a Zea mays clone, identified herein as CeresClone: 375578 (SEQ ID NO: 352), that is predicted to contain an IQ domain. For example, an aluminum tolerance-modulating polypeptide can comprise an IQ domain having 60 percent or greater (e.g., 65, 70, 75, 80, 85, 90, 95, 97, 98, 99, or 100%) sequence identity to residues 139 to 157 of SEQ ID NO: 353. In some embodiments, an aluminum tolerance-modulating polypeptide can comprise an IQ domain having 60 percent or greater (e.g., 65, 70, 75, 80, 85, 90, 95, 97, 98, 99, or 100%) sequence identity to the IQ domain of one or more of the polypeptides set forth in SEQ ID NOs: 355, 357, 358, 360, 362, 364, 366, 368, 369, 371, 373, 375, 376, 377, 378, 379, 380, 382, 384, 386, 388, 390, 392, 393, 395, 396, 397, 398, 399, 400, 401, 402, 404, 405, 407, 409, 411, 413, 414, 416, 418, 420, 421, 423, 424, 425, 426, 428, 429, 431, 432, 433, 434, 435, 436, 437, 438, 439, 440, 441, 442, 443, 444, 445, 446, 447, and 449. The IQ domain is a consensus for calcium-independent binding of calmodulin, which is a calcium sensor and helps regulate events through its interaction with a diverse group of cellular proteins. See Rhoads and Friedberg, FASEB J., 11(5):331-40 (1997).

In some embodiments, an aluminum tolerance-modulating polypeptide is truncated at the amino- or carboxy-terminal end of a naturally occurring polypeptide. A truncated polypeptide may retain certain domains of the naturally occurring polypeptide while lacking others. Thus, length variants that are up to 5 amino acids shorter or longer typically exhibit the aluminum tolerance-modulating activity of a truncated polypeptide. In some embodiments, a truncated polypeptide is a dominant negative polypeptide. Expression in a plant of such a truncated polypeptide confers a difference in the level of aluminum tolerance of a plant as compared to the corresponding level of a control plant that does not comprise the truncation.

B. Functional Homologs Identified by Reciprocal BLAST® (sequence similarity search)

In some embodiments, one or more functional homologs of a reference aluminum tolerance-modulating polypeptide defined by one or more of the Pfam descriptions indicated above are suitable for use as aluminum tolerance-modulating polypeptides. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs.

Functional homologs can also be created via site-directed mutagenesis of the coding sequence for an aluminum tolerance-modulating polypeptide, or by combining domains from the coding sequences for different naturally-occurring aluminum tolerance-modulating polypeptides ("domain swapping"). The term "functional homolog" is sometimes applied to the nucleic acid that encodes a functionally homologous polypeptide. Functional homologs can be identified by analysis of nucleotide and polypeptide sequence alignments. For example, performing a query on a database of nucleotide or polypeptide sequences can identify homologs of aluminum tolerance-modulating polypeptides. Sequence analysis can involve BLAST®, Reciprocal BLAST®, or PSI-BLAST® analysis of nonredundant databases using an aluminum tolerance-modulating polypeptide amino acid sequence as the reference sequence. Amino acid sequence is, in some instances, deduced from the nucleotide sequence. Those polypeptides in the database that have greater than 40% sequence identity are candidates for further evaluation for suitability as an aluminum tolerance-modulating polypeptide. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in aluminum tolerance-modulating polypeptides, e.g., conserved functional domains.

Conserved regions can be identified by locating a region within the primary amino acid sequence of an aluminum tolerance-modulating polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/ and pfam.janelia.org/. A description of the information included at the Pfam database is described in Sonnhammer et al., Nucl. Acids Res., 26:320-322 (1998); Sonnhammer et al., Proteins, 28:405-420 (1997); and Bateman et al., Nucl. Acids Res., 27:260-262 (1999). Conserved regions also can be determined by aligning sequences of the same or related polypeptides from closely related species. Closely related species preferably are from the same family. In some embodiments, alignment of sequences from two different species is adequate.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

Figure 1B:
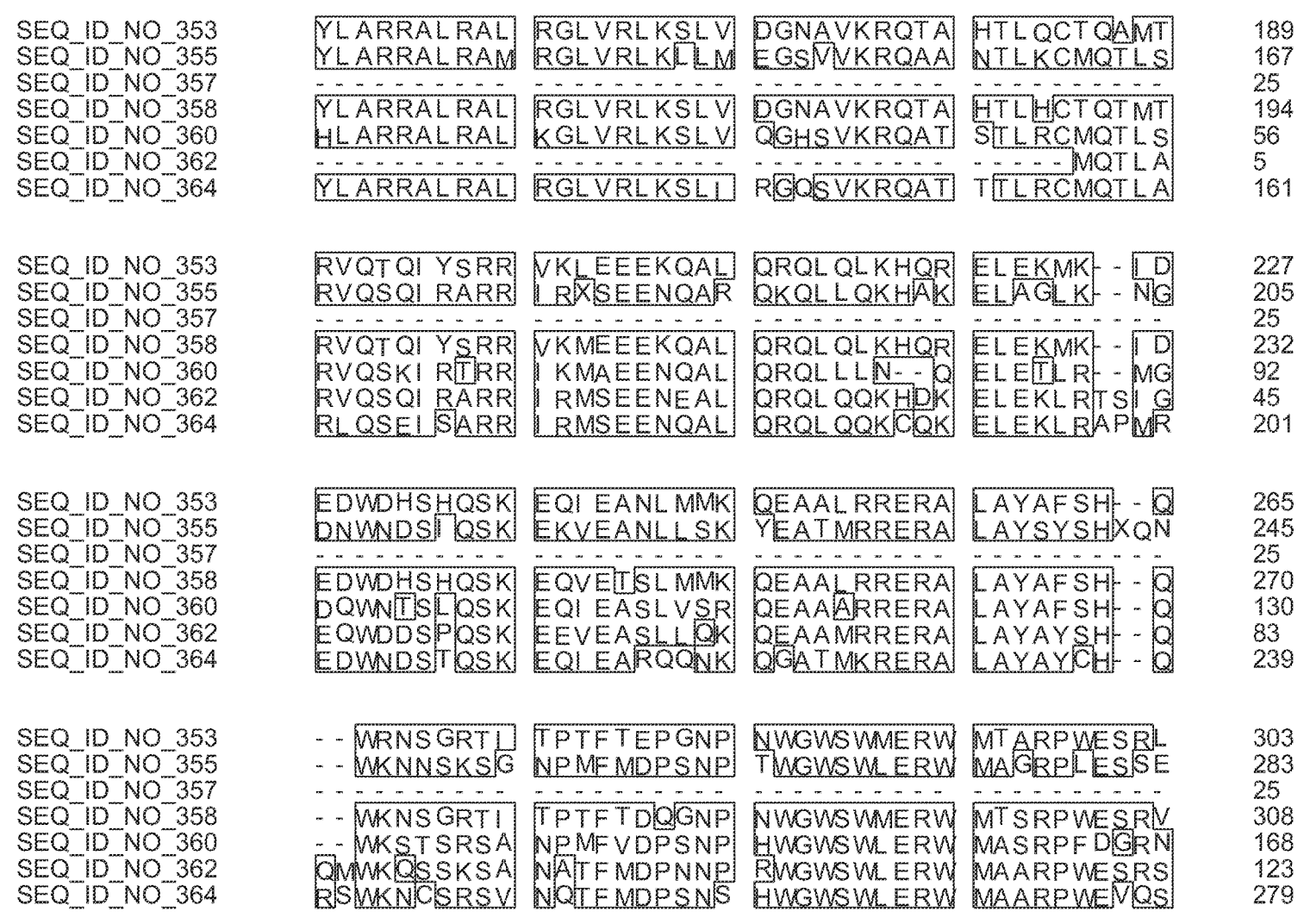

Examples of amino acid sequences of functional homologs of the polypeptide set forth in SEQ ID NO: 353 are provided in FIG. 1 and in the Sequence Listing. Such functional homologs include, for example, CeresClone_106263 (SEQ ID NO: 355), CeresClone_335348 (SEQ ID NO: 357), GI_115440873 (SEQ ID NO: 358), CeresClone_826796 (SEQ ID NO: 360), CeresAnnot_1465047 (SEQ ID NO: 362), CeresClone_1919901 (SEQ ID NO: 364), SEEDLINE: ME02064_CeresClone_375578 mutated (SEQ ID NO: 366), CeresClone_520008 (SEQ ID NO: 368), GI_7413581 (SEQ ID NO: 369), CeresClone_228069 (SEQ ID NO: 371), CeresClone_467508 (SEQ ID NO: 373), CeresClone_1829581 (SEQ ID NO: 375), GI_125550655 (SEQ ID NO: 376), GI_15231175 (SEQ ID NO: 377), GI_145357576 (SEQ ID NO: 378), GI_125528277 (SEQ ID NO: 379), GI_224032591 (SEQ ID NO: 380), CeresAnnot_8669409 (SEQ ID NO: 382), CeresClone_1901601 (SEQ ID NO: 384), CeresClone_2034697 (SEQ ID NO: 386), CeresClone_1747444 (SEQ ID NO: 388), CeresClone_1998974 (SEQ ID NO: 390), CeresClone_1883040 (SEQ ID NO: 392), GI_326520123 (SEQ ID NO: 393), CeresClone_101697218 (SEQ ID NO: 395), GI_215701453 (SEQ ID NO: 396), GI_225449126 (SEQ ID NO: 397), GI_147809623 (SEQ ID NO: 398), GI_224109704 (SEQ ID NO: 399), GI_225439898 (SEQ ID NO: 400), GI_218196002 (SEQ ID NO: 401), GI_54306075 (SEQ ID NO: 402), CeresAnnot_1484880 (SEQ ID NO: 404), GI_224028605 (SEQ ID NO: 405), CeresAnnot_1528800 (SEQ ID NO: 407), CeresClone_1792902 (SEQ ID NO: 409), CeresClone_1806867 (SEQ ID NO: 411), CeresClone_1727738 (SEQ ID NO: 413), GI_238007500 (SEQ ID NO: 414), CeresAnnot_8724651 (SEQ ID NO: 416), CeresClone_1897134 (SEQ ID NO: 418), CeresClone_1859266 (SEQ ID NO: 420), GI_194696788 (SEQ ID NO: 421), CeresAnnot_1475350 (SEQ ID NO: 423), GI_326490361 (SEQ ID NO: 424), GI_224140165 (SEQ ID NO: 425), GI_255577665 (SEQ ID NO: 426), CeresClone_1886384 (SEQ ID NO: 428), GI_255568402 (SEQ ID NO: 429), CeresClone_1942871 (SEQ ID NO: 431), GI_326527367 (SEQ ID NO: 432), GI_297816500 (SEQ ID NO: 433), GI_297810377 (SEQ ID NO: 434), GI_302762472 (SEQ ID NO: 435), GI_302815615 (SEQ ID NO: 436), GI_326525172 (SEQ ID NO: 437), GI_116787496 (SEQ ID NO: 438), GI_224029961 (SEQ ID NO: 439), GI_312282973 (SEQ ID NO: 440), GI_15232741 (SEQ ID NO: 441), GI_302806862 (SEQ ID NO: 442), GI_302772817 (SEQ ID NO: 443), GI_240254538 (SEQ ID NO: 444), GI_297833734 (SEQ ID NO: 445), GI_2739366 (SEQ ID NO: 446), GI_297825811 (SEQ ID NO: 447), and CeresClone_229668 (SEQ ID NO: 449). In some cases, a functional homolog of SEQ ID NO: 353 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 353. In some cases, a functional homolog of SEQ ID NO: 353 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 353 described above or set forth in the Sequence Listing. The polypeptide set forth in SEQ ID NO: 353, or the functional homologs set forth above or in the Sequence Listing, can be truncated at the N- or C-terminus. In one embodiment, a functional homolog of SEQ ID NO:353 contains an N-terminal truncation. For example, a functional homolog of SEQ ID NO: 353 such as SEQ ID NO:366 can include amino acids aligning with residues 188 to 498 of SEQ ID NO: 353.

Figure 2B:
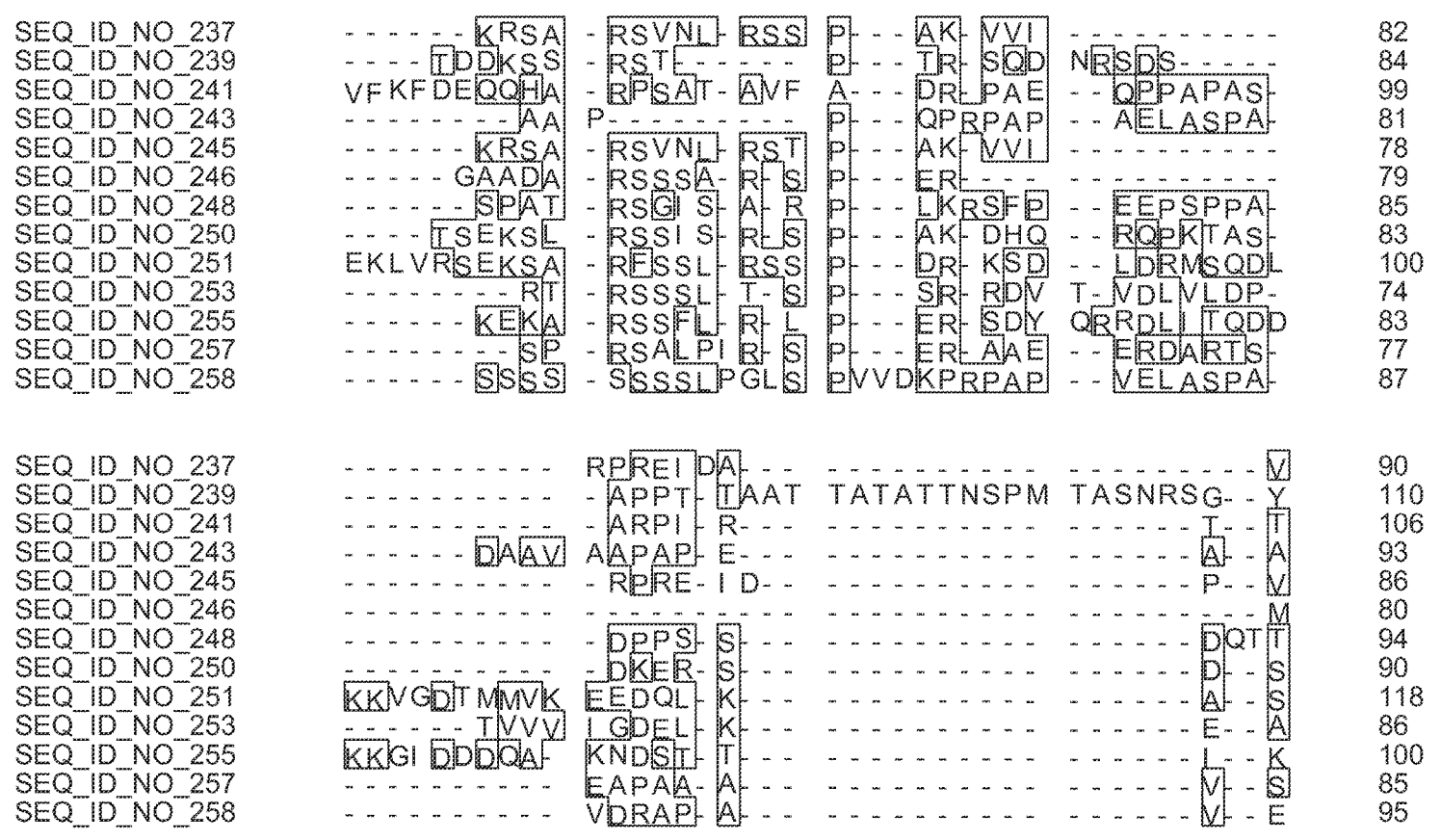

Examples of amino acid sequences of functional homologs of the polypeptide set forth in SEQ ID NO: 237 are provided in FIG. 2 and in the Sequence Listing. Such functional homologs include, for example, CeresClone_1847516 (SEQ ID NO: 239), CeresAnnot_8714481 (SEQ ID NO: 241), CeresClone_1961986 (SEQ ID NO: 243), CeresClone_1464596 (SEQ ID NO: 245), GI_225450173 (SEQ ID NO: 246), CeresClone_532446 (SEQ ID NO: 248), CeresAnnot_1493109 (SEQ ID NO: 250), GI_88866527 (SEQ ID NO: 251), CeresClone_1609861 (SEQ ID NO: 253), CeresClone_1620215 (SEQ ID NO: 255), CeresClone_1732772 (SEQ ID NO: 257), GI_295148935 (SEQ ID NO: 258), GI_125606142 (SEQ ID NO: 259), CeresClone_1040399 (SEQ ID NO: 261), CeresClone_1093691 (SEQ ID NO: 263), CeresClone_974539 (SEQ ID NO: 265), CeresClone_1832340 (SEQ ID NO: 267), CeresClone_1933211 (SEQ ID NO: 269), CeresClone_997558 (SEQ ID NO: 271), CeresAnnot_6041596 (SEQ ID NO: 273), GI_125564176 (SEQ ID NO: 274), CeresClone_1836064 (SEQ ID NO: 276), CeresClone_1909693 (SEQ ID NO: 278), CeresClone_1765346 (SEQ ID NO: 280), GI_125546008 (SEQ ID NO: 281), CeresClone_1950900 (SEQ ID NO: 283), GI_41350259 (SEQ ID NO: 284), GI_125588210 (SEQ ID NO: 285), CeresClone_1954395 (SEQ ID NO: 287), GI_18403408 (SEQ ID NO: 288), CeresClone_2010121 (SEQ ID NO: 290), CeresAnnot_6011486 (SEQ ID NO: 292), GI_25082726 (SEQ ID NO: 293), GI_113196593 (SEQ ID NO: 294), CeresClone_1843021 (SEQ ID NO: 296), CeresClone_1931194 (SEQ ID NO: 298), CeresClone_1850070 (SEQ ID NO: 300), CeresAnnot_6034955 (SEQ ID NO: 302), CeresAnnot_6119444 (SEQ ID NO: 304), CeresAnnot_6063956 (SEQ ID NO: 306), CeresAnnot_6015461 (SEQ ID NO: 308), CeresClone_696244 (SEQ ID NO: 310), CeresAnnot_1468973 (SEQ ID NO: 312), CeresClone_2019529 (SEQ ID NO: 314), CeresClone_1492169 (SEQ ID NO: 316), CeresClone_1652996 (SEQ ID NO: 318), CeresClone_100861292 (SEQ ID NO: 320), CeresClone_1875452 (SEQ ID NO: 322), CeresClone_296366 (SEQ ID NO: 324), CeresClone_1468822 (SEQ ID NO: 326), CeresClone_1793946 (SEQ ID NO: 328), GI_297829802 (SEQ ID NO: 329), CeresClone_1094610 (SEQ ID NO: 331), CeresClone_1084216 (SEQ ID NO: 333), CeresClone_100041169 (SEQ ID NO: 335), CeresClone_1619774 (SEQ ID NO: 337), GI_218685692 (SEQ ID NO: 338), GI_295148937 (SEQ ID NO: 339), CeresClone_1783953 (SEQ ID NO: 341), GI_242045152 (SEQ ID NO: 342), GI_223972713 (SEQ ID NO: 343), GI_326494504 (SEQ ID NO: 344), GI_326515226 (SEQ ID NO: 345), GI_163838754 (SEQ ID NO: 346), GI_163838756 (SEQ ID NO: 347), GI_163838762 (SEQ ID NO: 348), GI_326523409 (SEQ ID NO: 349), GI_255544230 (SEQ ID NO: 350), and GI_222822669 (SEQ ID NO: 351). In some cases, a functional homolog of SEQ ID NO: 237 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 237. In some cases, a functional homolog of SEQ ID NO: 237 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 237 described above or set forth in the Sequence Listing.

Figure 3A:
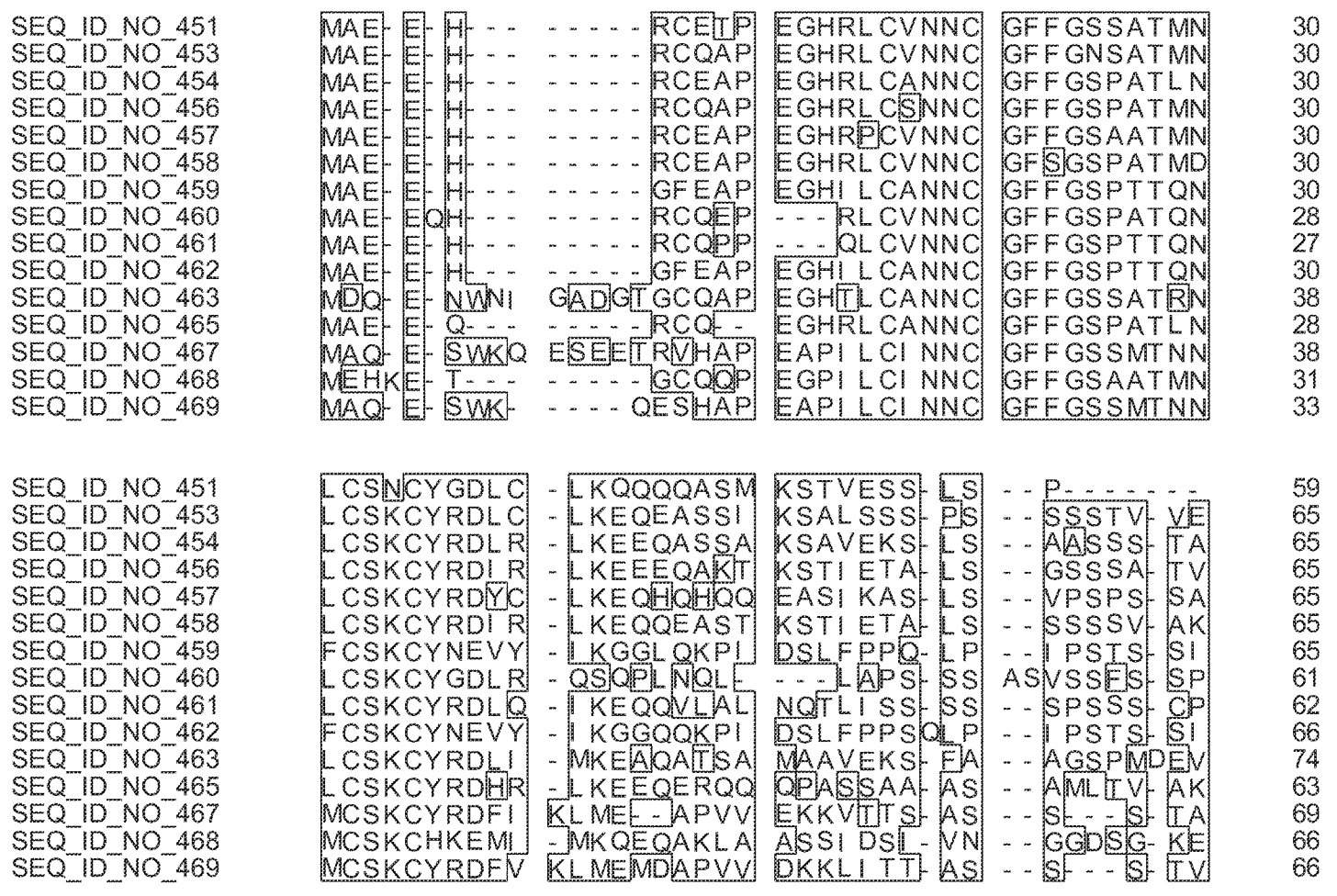
Figure 3B:
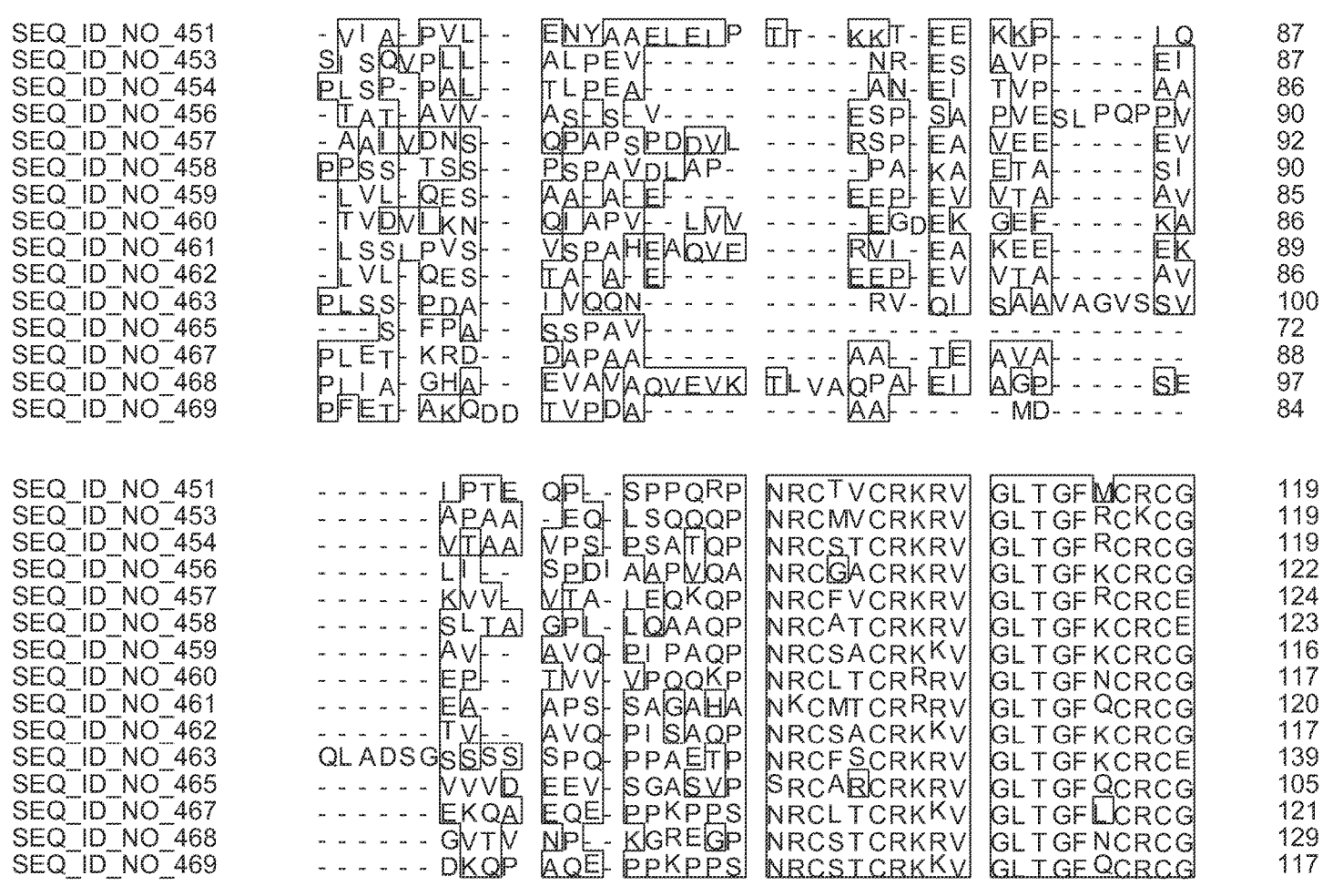

Examples of amino acid sequences of functional homologs of the polypeptide set forth in SEQ ID NO: 451 are provided in FIG. 3 and in the Sequence Listing. Such functional homologs include, for example, CeresClone_1931889 (SEQ ID NO: 453), GI_225440926 (SEQ ID NO: 454), CeresClone_708446 (SEQ ID NO: 456), GI_255575635 (SEQ ID NO: 457), GI_193237563 (SEQ ID NO: 458), GI_222822693 (SEQ ID NO: 459), GI_224103059 (SEQ ID NO: 460), GI_302398693 (SEQ ID NO: 461), GI_222822667 (SEQ ID NO: 462), GI_116778998 (SEQ ID NO: 463), CeresClone_1748922 (SEQ ID NO: 465), CeresClone_1775820 (SEQ ID NO: 467), GI_115468934 (SEQ ID NO: 468), GI_118424243 (SEQ ID NO: 469), GI_147783026 (SEQ ID NO: 470), GI_119367488 (SEQ ID NO: 471), GI_147860340 (SEQ ID NO: 472), GI_147792975 (SEQ ID NO: 473), GI_21359918 (SEQ ID NO: 474), GI_73951300 (SEQ ID NO: 475), GI_115477170 (SEQ ID NO: 476), CeresClone_1798756 (SEQ ID NO: 478), CeresClone_1918424 (SEQ ID NO: 480), CeresClone_1929645 (SEQ ID NO: 482), CeresClone_1845154 (SEQ ID NO: 484), CeresClone_1840507 (SEQ ID NO: 486), CeresClone_1853430 (SEQ ID NO: 488), CeresClone_1853189 (SEQ ID NO: 490), CeresClone_1808578 (SEQ ID NO: 492), CeresClone_1857508 (SEQ ID NO: 494), CeresClone_1946245 (SEQ ID NO: 496), CeresClone_1974721 (SEQ ID NO: 498), CeresClone_1940441 (SEQ ID NO: 500), CeresClone_1834813 (SEQ ID NO: 502), CeresClone_1848383 (SEQ ID NO: 504), CeresClone_1895219 (SEQ ID NO: 506), CeresClone_1866608 (SEQ ID NO: 508), CeresAnnot_1481252 (SEQ ID NO: 510), CeresAnnot_1474904 (SEQ ID NO: 512), CeresAnnot_1450673 (SEQ ID NO: 514), CeresAnnot_1437933 (SEQ ID NO: 516), CeresAnnot_1448174 (SEQ ID NO: 518), CeresAnnot_1447323 (SEQ ID NO: 520), CeresAnnot_1456578 (SEQ ID NO: 522), CeresAnnot_1491680 (SEQ ID NO: 524), CeresAnnot_1438851 (SEQ ID NO: 526), CeresAnnot_1440235 (SEQ ID NO: 528), CeresAnnot_1461453 (SEQ ID NO: 530), CeresAnnot_1468974 (SEQ ID NO: 532), CeresAnnot_1474244 (SEQ ID NO: 534), GI_15231686 (SEQ ID NO: 535), CeresClone_5522 (SEQ ID NO: 537), CeresClone_30543 (SEQ ID NO: 539), GI_14596167 (SEQ ID NO: 540), CeresClone_14203 (SEQ ID NO: 542), CeresClone_13832 (SEQ ID NO: 544), GI_15221329 (SEQ ID NO: 545), CeresClone_975913 (SEQ ID NO: 547), CeresClone_967417 (SEQ ID NO: 549), CeresClone_974951 (SEQ ID NO: 551), CeresClone_958471 (SEQ ID NO: 553), CeresClone_979956 (SEQ ID NO: 555), CeresClone_962327 (SEQ ID NO: 557), GI_119720772 (SEQ ID NO: 558), CeresClone_1614593 (SEQ ID NO: 560), CeresClone_567184 (SEQ ID NO: 562), CeresClone_580467 (SEQ ID NO: 564), CeresClone_1021029 (SEQ ID NO: 568), CeresClone_1072112 (SEQ ID NO: 570), CeresClone_481246 (SEQ ID NO: 572), CeresClone_1242573 (SEQ ID NO: 574), CeresClone_537439 (SEQ ID NO: 576), CeresClone_547126 (SEQ ID NO: 578), GI_92896423 (SEQ ID NO: 579), GI_124360119 (SEQ ID NO: 580), GI_122069751 (SEQ ID NO: 581), CeresClone_1030374 (SEQ ID NO: 583), CeresClone_1030540 (SEQ ID NO: 585), CeresClone_634261 (SEQ ID NO: 587), CeresClone_696374 (SEQ ID NO: 589), CeresClone_698573 (SEQ ID NO: 591), CeresClone_701370 (SEQ ID NO: 593), CeresClone_893059 (SEQ ID NO: 595), CeresClone_757664 (SEQ ID NO: 597), CeresClone_1387149 (SEQ ID NO: 599), CeresClone_1411371 (SEQ ID NO: 601), CeresClone_1380920 (SEQ ID NO: 603), CeresClone_1360570 (SEQ ID NO: 605), CeresClone_1458498 (SEQ ID NO: 607), GI_60202503 (SEQ ID NO: 608), CeresClone_1554153 (SEQ ID NO: 610), CeresClone_1362320 (SEQ ID NO: 612), CeresClone_1545291 (SEQ ID NO: 614), CeresClone_1589047 (SEQ ID NO: 616), CeresClone_101142707 (SEQ ID NO: 618), CeresClone_1433926 (SEQ ID NO: 620), CeresClone_1734621 (SEQ ID NO: 622), CeresClone_1731531 (SEQ ID NO: 624), GI_5031281 (SEQ ID NO: 625), CeresClone_1911017 (SEQ ID NO: 627), CeresClone_1955228 (SEQ ID NO: 629), CeresClone_1867313 (SEQ ID NO: 631), CeresClone_1955668 (SEQ ID NO: 633), CeresClone_1765871 (SEQ ID NO: 635), CeresClone_1870976 (SEQ ID NO: 637), CeresClone_1990071 (SEQ ID NO: 639), CeresClone_1965620 (SEQ ID NO: 641), CeresClone_1995041 (SEQ ID NO: 643), CeresClone_2015820 (SEQ ID NO: 645), CeresClone_1724157 (SEQ ID NO: 647), CeresClone_1724165 (SEQ ID NO: 649), GI_35187687 (SEQ ID NO: 650), GI_125556051 (SEQ ID NO: 651), GI_125561658 (SEQ ID NO: 652), GI_115470773 (SEQ ID NO: 653), GI_115444813 (SEQ ID NO: 654), GI_115446479 (SEQ ID NO: 655), GI_115455855 (SEQ ID NO: 656), GI_115479855 (SEQ ID NO: 657), GI_57899571 (SEQ ID NO: 658), CeresAnnot_6035031 (SEQ ID NO: 660), CeresAnnot_6111586 (SEQ ID NO: 662), CeresAnnot_6011488 (SEQ ID NO: 664), CeresAnnot_6063958 (SEQ ID NO: 666), CeresAnnot_6063957 (SEQ ID NO: 668), GI_38016527_Gossypium_barbadense (SEQ ID NO: 669), GI_75133829_Oryza_sativa (SEQ ID NO: 670), GI_125546011_Oryza_sativa_indica (SEQ ID NO: 671), GI_116778802_Picea (SEQ ID NO: 672), GI_116778893_Picea (SEQ ID NO: 673), GI_157849766_Brassica_rapa (SEQ ID NO: 674), GI_159474166_Chlamydomonas_reinhardtii (SEQ ID NO: 675), GI_168036656_Physcomitrella_patens (SEQ ID NO: 676), GI_168053490_Physcomitrella_patens (SEQ ID NO: 677), CeresClone_100879386_Zea mays (SEQ ID NO: 679), CeresClone_1738028_Musa_acuminata (SEQ ID NO: 681), CeresClone_2055733_Miscanthus (SEQ ID NO: 683), CeresClone_2056478 Miscanthus (SEQ ID NO: 685), GI_297823437 (SEQ ID NO: 686), GI_297816570 (SEQ ID NO: 687), CeresClone_1428270 (SEQ ID NO: 689), CeresClone_1447811 (SEQ ID NO: 691), CeresClone_1093477 (SEQ ID NO: 693), CeresClone_1260056 (SEQ ID NO: 695), GI_255565591 (SEQ ID NO: 696), CeresClone_1626661 (SEQ ID NO: 698), GI_222822665 (SEQ ID NO: 699), CeresClone_1842119 (SEQ ID NO: 701), GI_222822659 (SEQ ID NO: 702), GI_222822691 (SEQ ID NO: 703), GI_255544810 (SEQ ID NO: 704), GI_297847482 (SEQ ID NO: 705), GI_116791002 (SEQ ID NO: 706), GI_297809513 (SEQ ID NO: 707), CeresClone_100049493 (SEQ ID NO: 709), GI_222822685 (SEQ ID NO: 710), GI_301133546 (SEQ ID NO: 711), GI_225426659 (SEQ ID NO: 712), GI_297799728 (SEQ ID NO: 713), GI_15234402 (SEQ ID NO: 714), GI_254030287 (SEQ ID NO: 715), GI_222423788 (SEQ ID NO: 716), GI_222822679 (SEQ ID NO: 717), GI_222822653 (SEQ ID NO: 718), GI_302787300 (SEQ ID NO: 719), CeresClone_1955772 (SEQ ID NO: 721), GI_222822655 (SEQ ID NO: 722), GI_225435496 (SEQ ID NO: 723), GI_15235819 (SEQ ID NO: 724), GI_212275744 (SEQ ID NO: 725), GI_116787141 (SEQ ID NO: 726), GI_238575930 (SEQ ID NO: 727), GI_326515250 (SEQ ID NO: 728), GI_217075260 (SEQ ID NO: 729), GI_222622367 (SEQ ID NO: 730), GI_222822681 (SEQ ID NO: 731), GI_194692334 (SEQ ID NO: 732), GI_116791662 (SEQ ID NO: 733), GI_168007673 (SEQ ID NO: 734), GI_222822687 (SEQ ID NO: 735), GI_326499404 (SEQ ID NO: 736), GI_255628951 (SEQ ID NO: 737), GI_326496248 (SEQ ID NO: 738), GI_297849616 (SEQ ID NO: 739), GI_326489039 (SEQ ID NO: 740), CeresAnnot_8672029 (SEQ ID NO: 742), CeresClone_24253 (SEQ ID NO: 744), GI_297739707 (SEQ ID NO: 745), GI_217075452 (SEQ ID NO: 746), GI_168037934 (SEQ ID NO: 747), CeresClone_682858 (SEQ ID NO: 749), GI_222822689 (SEQ ID NO: 750), CeresAnnot_8644539 (SEQ ID NO: 752), GI_222822663

(SEQ ID NO: 753), GI_168018442 (SEQ ID NO: 754), GI_242081565 (SEQ ID NO: 755), CeresClone_1463779 (SEQ ID NO: 757), CeresAnnot_8713173 (SEQ ID NO: 759), GI_225455582 (SEQ ID NO: 760), GI_218189113 (SEQ ID NO: 761), GI_302755624 (SEQ ID NO: 762), CeresClone_1778054 (SEQ ID NO: 764), GI_302822895 (SEQ ID NO: 765), GI_255638082 (SEQ ID NO: 766), GI_297746352 (SEQ ID NO: 767), GI_255640538 (SEQ ID NO: 768), GI_13276697 (SEQ ID NO: 769), GI_255628269 (SEQ ID NO: 770), GI_297804888 (SEQ ID NO: 771), and GI_297736227 (SEQ ID NO: 772). In some cases, a functional homolog of SEQ ID NO: 451 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 451. In some cases, a functional homolog of SEQ ID NO: 451 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 451 described above or set forth in the Sequence Listing.

Examples of amino acid sequences of functional homologs of the polypeptide set forth in SEQ ID NO: 2 are provided in FIG. 4 and in the Sequence Listing. Such functional homologs include, for example, GI_239053200 (SEQ ID NO: 3), GI_242043390 (SEQ ID NO: 4), GI_4218535 (SEQ ID NO: 5), CeresAnnot_1706255 (SEQ ID NO: 7), GI_82400207 (SEQ ID NO: 8), GI_326514348 (SEQ ID NO: 9), GI_225435840 (SEQ ID NO: 10), GI_155965519 (SEQ ID NO: 11), GI_116791569 (SEQ ID NO: 12), GI_82568708 (SEQ ID NO: 13), GI_21105748 (SEQ ID NO: 14), GI_154362215 (SEQ ID NO: 15), CeresClone_1804251 (SEQ ID NO: 17), CeresClone_219367 (SEQ ID NO: 19), GI_226528637 (SEQ ID NO: 20), CeresClone_100906935 (SEQ ID NO: 22), CeresClone_1902485 (SEQ ID NO: 24), CeresClone_754901 (SEQ ID NO: 26), CeresClone_1804740 (SEQ ID NO: 28), GI_88770831 (SEQ ID NO: 29), CeresClone_100885834 (SEQ ID NO: 31), GI_125557725 (SEQ ID NO: 32), GI_115471229 (SEQ ID NO: 33), CeresAnnot_8631975 (SEQ ID NO: 35), GI_261349144 (SEQ ID NO: 36), CeresClone_261978 (SEQ ID NO: 38), CeresClone_1797688 (SEQ ID NO: 40), GI_300510868 (SEQ ID NO: 41), GI_51702426 (SEQ ID NO: 42), GI_219884691 (SEQ ID NO: 43), GI_292659262 (SEQ ID NO: 44), GI_82400213 (SEQ ID NO: 45), CeresClone_1566599 (SEQ ID NO: 47), GI_6730938 (SEQ ID NO: 48), GI_125528153 (SEQ ID NO: 49), GI_185179439 (SEQ ID NO: 50), CeresClone_1810747 (SEQ ID NO: 52), CeresClone_736293 (SEQ ID NO: 54), GI_292659260 (SEQ ID NO: 55), GI_242059063 (SEQ ID NO: 56), GI_82400209 (SEQ ID NO: 57), GI_223975401 (SEQ ID NO: 58), GI_138753440 (SEQ ID NO: 59), CeresClone_101131915 (SEQ ID NO: 61), CeresClone_100821085 (SEQ ID NO: 63), GI_302399001 (SEQ ID NO: 64), GI_225459603 (SEQ ID NO: 65), GI_302141792 (SEQ ID NO: 66), GI_125572421 (SEQ ID NO: 67), CeresClone_542522 (SEQ ID NO: 69), GI_195549547 (SEQ ID NO: 70), CeresClone_100961037 (SEQ ID NO: 72), GI_255640977 (SEQ ID NO: 73), CeresClone_1850651 (SEQ ID NO: 75), CeresAnnot_8462230 (SEQ ID NO: 77), GI_198400323 (SEQ ID NO: 78), GI_254034330 (SEQ ID NO: 79), CeresClone_100066176 (SEQ ID NO: 81), GI_206584339 (SEQ ID NO: 82), GI_224063050 (SEQ ID NO: 83), GI_312282805 (SEQ ID NO: 84), GI_255558632 (SEQ ID NO: 85), GI_21105734 (SEQ ID NO: 86), GI_116784797 (SEQ ID NO: 87), GI_187940307 (SEQ ID NO: 88), GI_184097796 (SEQ ID NO: 89), GI_222631638 (SEQ ID NO: 90), GI_116782512 (SEQ ID NO: 91), CeresClone_1220729 (SEQ ID NO: 93), GI_14485513 (SEQ ID NO: 94), CeresClone_514804 (SEQ ID NO: 96), GI_155008462 (SEQ ID NO: 97), GI_292659252 (SEQ ID NO: 98), GI_296044564 (SEQ ID NO: 99), GI_187940295 (SEQ ID NO: 100), CeresAnnot_8732688 (SEQ ID NO: 102), GI_302789271 (SEQ ID NO: 103), GI_206584337 (SEQ ID NO: 104), GI_326490045 (SEQ ID NO: 105), GI_31322570 (SEQ ID NO: 106), GI_168000027 (SEQ ID NO: 107), GI_297839605 (SEQ ID NO: 108), GI_62546185 (SEQ ID NO: 109), GI_147802535 (SEQ ID NO: 110), GI_302820063 (SEQ ID NO: 111), CeresClone_1769201 (SEQ ID NO: 113), CeresClone_477097 (SEQ ID NO: 115), CeresClone_1910025 (SEQ ID NO: 117), CeresAnnot_8669922 (SEQ ID NO: 119), GI_31322574 (SEQ ID NO: 120), GI_187940273 (SEQ ID NO: 121), GI_15223963 (SEQ ID NO: 122), CeresClone_100038358 (SEQ ID NO: 124), GI_148615629 (SEQ ID NO: 125), GI_225461361 (SEQ ID NO: 126), GI_255563837 (SEQ ID NO: 127), CeresClone_1727754 (SEQ ID NO: 129), CeresClone_1808216 (SEQ ID NO: 131), GI_195549534 (SEQ ID NO: 132), CeresAnnot_1466775 (SEQ ID NO: 134), CeresClone_23342 (SEQ ID NO: 136), GI_209171097 (SEQ ID NO: 137), GI_138753442 (SEQ ID NO: 138), CeresClone_1431867 (SEQ ID NO: 140), CeresClone_36478 (SEQ ID NO: 142), CeresClone_1864096 (SEQ ID NO: 144), CeresAnnot_1452119 (SEQ ID NO: 146), GI_302774106 (SEQ ID NO: 147), GI_171452372 (SEQ ID NO: 148), GI_297810999 (SEQ ID NO: 149), GI_21593134 (SEQ ID NO: 150), GI_125572883 (SEQ ID NO: 151), GI_242877145 (SEQ ID NO: 152), GI_125528621 (SEQ ID NO: 153), GI_115441473 (SEQ ID NO: 154), GI_31322566 (SEQ ID NO: 155), GI_224128213 (SEQ ID NO: 156), CeresClone_481915 (SEQ ID NO: 158), GI_31322580 (SEQ ID NO: 159), GI_311701727 (SEQ ID NO: 160), CeresClone_1434586 (SEQ ID NO: 162), GI_58013003 (SEQ ID NO: 163), GI_255586554 (SEQ ID NO: 164), CeresClone_1370400 (SEQ ID NO: 166), GI_312283489 (SEQ ID NO: 167), CeresAnnot_8453910 (SEQ ID NO: 169), CeresClone_1824711 (SEQ ID NO: 171), GI_57233056 (SEQ ID NO: 172), GI_167614348 (SEQ ID NO: 173), GI_296082607 (SEQ ID NO: 174), GI_62546187 (SEQ ID NO: 175), GI_62546189 (SEQ ID NO: 176), GI_31322568 (SEQ ID NO: 177), GI_66275774 (SEQ ID NO: 178), GI_225438363 (SEQ ID NO: 179), GI_124021383 (SEQ ID NO: 180), GI_224081060 (SEQ ID NO: 181), GI_255583865 (SEQ ID NO: 182), GI_217073174 (SEQ ID NO: 183), GI_168038326 (SEQ ID NO: 184), GI_295913643 (SEQ ID NO: 185), GI_31322578 (SEQ ID NO: 186), GI_118486672 (SEQ ID NO: 187), GI_15232604 (SEQ ID NO: 188), CeresAnnot_8683724 (SEQ ID NO: 190), GI_187940303 (SEQ ID NO: 191), GI_311780299 (SEQ ID NO: 192), GI_297830130 (SEQ ID NO: 193), GI_117586720 (SEQ ID NO: 194), GI_193237579 (SEQ ID NO: 195), CeresClone_1827014 (SEQ ID NO: 197), GI_31322576 (SEQ ID NO: 198), GI_255555947 (SEQ ID NO: 199), GI_125533643 (SEQ ID NO: 200), GI_118490007 (SEQ ID NO: 201), GI_21536744 (SEQ ID NO: 202), GI_302399025 (SEQ ID NO: 203), CeresClone_100046091 (SEQ ID NO: 205), CeresClone_20909 (SEQ ID NO: 207), CeresClone_1803889 (SEQ ID NO: 209), CeresAnnot_1456291 (SEQ ID NO: 211), GI_311976585 (SEQ ID NO: 212), GI_302399005 (SEQ ID NO: 213), GI_297744870 (SEQ ID NO: 214), GI_15223456 (SEQ ID NO: 215), GI_63252923 (SEQ ID NO: 216), GI_255636538 (SEQ ID NO: 217), GI_113205414 (SEQ ID NO: 218), GI_113205453 (SEQ ID NO: 219), GI_255635167 (SEQ ID NO: 220), GI_206584345 (SEQ ID NO: 221), CeresAnnot_867355 (SEQ ID NO: 223), GI_242877103 (SEQ ID NO: 224), GI_302793560 (SEQ ID NO: 225), CeresClone_38344 (SEQ ID NO: 227), GI_31322582 (SEQ ID NO: 228), GI_115336269 (SEQ ID NO: 229), GI_311115260 (SEQ ID NO: 230), GI_168054147 (SEQ ID NO: 231), GI_311115262 (SEQ ID NO: 232), GI_168034283 (SEQ ID NO: 233), GI_15148914 (SEQ ID NO: 234), and GI_302767458 (SEQ ID NO: 235). In some cases, a functional homolog of SEQ ID NO: 2 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2. In some cases, a functional homolog of SEQ ID NO: 2 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one or more functional homologs of SEQ ID NO: 2 described above or set forth in the Sequence Listing.

The identification of conserved regions in an aluminum tolerance-modulating polypeptide facilitates production of variants of aluminum tolerance-modulating polypeptides. Variants of aluminum tolerance-modulating polypeptides typically have 10 or fewer conservative amino acid substitutions within the primary amino acid sequence, e.g., 7 or fewer conservative amino acid substitutions, 5 or fewer conservative amino acid substitutions, or between 1 and 5 conservative substitutions. A useful variant polypeptide can be constructed based on one of the alignments set forth in FIG. 1, FIG. 2, FIG. 3, or FIG. 4, and/or homologs identified in the Sequence Listing. Such a polypeptide includes the conserved regions, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at a position marked by dashes, such a polypeptide has a length that is the sum of the amino acid residues in all conserved regions and all dashes.

C. Functional Homologs Identified by HMMER

In some embodiments, useful aluminum tolerance-modulating polypeptides include those that fit a Hidden Markov Model based on the polypeptides set forth in any one of FIGS. 1-4. A Hidden Markov Model (HMM) is a statistical model of a consensus sequence for a group of functional homologs. See, Durbin et al., *Biological Sequence Analysis Probabilistic Models of Proteins and Nucleic Acids*, Cambridge University Press, Cambridge, UK (1998). An HMM is generated by the program HMMER 2.3.2 with default program parameters, using the sequences of the group of functional homologs as input. The multiple sequence alignment is generated by ProbCons (Do et al., Genome Res., 15(2):330-40 (2005)) version 1.11 using a set of default parameters: -c, —consistency REPS of 2; -ir, —iterative-refinement REPS of 100; -pre, —pre-training REPS of 0. ProbCons is a public domain software program provided by Stanford University.

The default parameters for building an HMM (hmmbuild) are as follows: the default "architecture prior" (archpri) used by MAP architecture construction is 0.85, and the default cutoff threshold (idlevel) used to determine the effective sequence number is 0.62. HMMER 2.3.2 was released Oct. 3, 2003 under a GNU general public license, and is available from various sources on the World Wide Web such as hmmer.janelia.org; hmmer.wustl.edu; and fr.com/hmmer232/. Hmmbuild outputs the model as a text file.

The HMM for a group of functional homologs can be used to determine the likelihood that a candidate aluminum tolerance-modulating polypeptide sequence is a better fit to that particular HMM than to a null HMM generated using a group of sequences that are not structurally or functionally related. The likelihood that a candidate polypeptide sequence is a better fit to an HMM than to a null HMM is indicated by the HMM bit score, a number generated when the candidate sequence is fitted to the HMM profile using the HMMER hmmsearch program. The following default parameters are used when running hmmsearch: the default E-value cutoff (E) is 10.0, the default bit score cutoff (T) is negative infinity, the default number of sequences in a database (Z) is the real number of sequences in the database, the default E-value cutoff for the per-domain ranked hit list (domE) is infinity, and the default bit score cutoff for the per-domain ranked hit list (domT) is negative infinity. A high HMM bit score indicates a greater likelihood that the candidate sequence carries out one or more of the biochemical or physiological function(s) of the polypeptides used to generate the HMM. A high HMM bit score is at least 20, and often is higher. Slight variations in the HMM bit score of a particular sequence can occur due to factors such as the order in which sequences are processed for alignment by multiple sequence alignment algorithms such as the ProbCons program. Nevertheless, such HMM bit score variation is minor.

The aluminum tolerance-modulating polypeptides discussed below fit the indicated HMM with an HMM bit score greater than to 65 (e.g., greater than 70, 80, 90, 100, 120, 140, 200, 300, 400, 500, 600, 700, 800, 900, 1000, 1500, or 2000). In some embodiments, the HMM bit score of an aluminum tolerance-modulating polypeptide discussed below is about 50%, 60%, 70%, 80%, 90%, or 95% of the HMM bit score of a functional homolog provided in the Sequence Listing of this application. In some embodiments, an aluminum tolerance-modulating polypeptide discussed below fits the indicated HMM with an HMM bit score greater than 210, and has a domain indicative of an aluminum tolerance-modulating polypeptide. In some embodiments, an aluminum tolerance-modulating polypeptide discussed below fits the indicated HMM with an HMM bit score greater than 210, and has 65% or greater sequence identity (e.g., 75%, 80%, 85%, 90%, 95%, or 100% sequence identity) to an amino acid sequence shown in any one of FIGS. 1-4.

Examples of polypeptides are shown in the sequence listing that have HMM bit scores greater than 159 (e.g., greater than 160, 170, 180, 190, 200, 225, 250, 275, 300, 325, 350, 375, 400, 425, 450, 475, 500, 525, 550, 575, 600, 625, 650, 675, 700, 725, 750, 775, 800, 825, 850, 875, 900, 925, 950, 975, 1000, 1025, 1050, 1075, 1100, 1125, 1150, 1175, 1200, 1225, 1250, or 1260) when fitted to an HMM generated from the amino acid sequences set forth in FIG. 1 are identified in the Sequence Listing of this application. Such polypeptides include, for example, SEQ ID NOs: 353, 355, 357, 358, 360, 362, 364, 366, 368, 369, 371, 373, 375, 376, 377, 378, 379, 380, 382, 384, 386, 388, 390, 392, 393, 395, 396, 397, 398, 399, 400, 401, 402, 404, 405, 407, 409, 411, 413, 414, 416, 418, 420, 421, 423, 424, 425, 426, 428, 429, 431, 432, 433, 434, 435, 436, 437, 438, 439, 440, 441, 442, 443, 444, 445, 446, 447, and 449.

Examples of polypeptides are shown in the sequence listing that have HMM bit scores greater than 83 (e.g., greater than 85, 90, 95, 100, 110, 120, 130, 140, 150, 175, 200, 225, 250, 275, or 300) when fitted to an HMM generated from the amino acid sequences set forth in FIG. 2 are identified in the Sequence Listing of this application. Such polypeptides include, for example, SEQ ID NOs: 237, 239, 241, 243, 245, 246, 248, 250, 251, 253, 255, 257, 258, 259, 261, 263, 265, 267, 269, 271, 273, 274, 276, 278, 280, 281, 283, 284, 285, 287, 288, 290, 292, 293, 294, 296, 298, 300, 302, 304, 306, 308, 310, 312, 314, 316, 318, 320, 322, 324, 326, 328, 329, 331, 333, 335, 337, 338, 339, 341, 342, 343, 344, 345, 346, 347, 348, 349, 350, and 351.

Examples of polypeptides are shown in the sequence listing that have HMM bit scores greater than 100 (e.g., greater than 110, 120, 130, 140, 150, 160, 170, 180, 190, 200, 225, 250, 275, 300, 325, 350, 375, 400, 410, 420, or 430) when fitted to an HMM generated from the amino acid sequences set forth in FIG. 3 are identified in the Sequence Listing of this application. Such polypeptides include, for example, SEQ ID NOs: 451, 453, 454, 456, 457, 458, 459, 460, 461, 462, 463, 465, 467, 468, 469, 470, 471, 472, 473, 474, 475, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 535, 537, 539, 540, 542, 544, 545, 547, 549, 551, 553, 555, 557, 558, 560, 562, 564, 568, 570, 572, 574, 576, 578, 579, 580, 581, 583, 585, 587, 589, 591, 593, 595, 597, 599, 601, 603, 605, 607, 608, 610, 612, 614, 616, 618, 620, 622, 624, 625, 627, 629, 631, 633, 635, 637, 639, 641, 643, 645, 647, 649, 650, 651, 652, 653, 654, 655, 656, 657, 658, 660, 662, 664, 666, 668, 669, 670, 671, 672, 673, 674, 675, 676, 677, 679, 681, 683, 685, 686, 687, 689, 691, 693, 695, 696, 698, 699, 701, 702, 703, 704, 705, 706, 707, 709, 710, 711, 712, 713, 714, 715, 716, 717, 718, 719, 721, 722, 723, 724, 725, 726, 727, 728, 729, 730, 731, 732, 733, 734, 735, 736, 737, 738, 739, 740, 742, 744, 745, 746, 747, 749, 750, 752, 753, 754, 755, 757, 759, 760, 761, 762, 764, 765, 766, 767, 768, 769, 770, 771, and 772.

Examples of polypeptides are shown in the sequence listing that have HMM bit scores greater than 204 (e.g., greater than 210, 220, 230, 240, 250, 260, 270, 280, 290, 300, 325, 350, 375, 400, 425, 450, 475, 500, 525, 550, 575, 600, 625, 650, 675, or 700) when fitted to an HMM generated from the amino acid sequences set forth in FIG. 4 are identified in the Sequence Listing of this application. Such polypeptides include, for example, SEQ ID NOs: 2, 3, 4, 5, 7, 8, 9, 10, 11, 12, 13, 14, 15, 17, 19, 20, 22, 24, 26, 28, 29, 31, 32, 33, 35, 36, 38, 40, 41, 42, 43, 44, 45, 47, 48, 49, 50, 52, 54, 55, 56, 57, 58, 59, 61, 63, 64, 65, 66, 67, 69, 70, 72, 73, 75, 77, 78, 79, 81, 82, 83, 84, 85, 86, 87, 88, 89, 90, 91, 93, 94, 96, 97, 98, 99, 100, 102, 103, 104, 105, 106, 107, 108, 109, 110, 111, 113, 115, 117, 119, 120, 121, 122, 124, 125, 126, 127, 129, 131, 132, 134, 136, 137, 138, 140, 142, 144, 146, 147, 148, 149, 150, 151, 152, 153, 154, 155, 156, 158, 159, 160, 162, 163, 164, 166, 167, 169, 171, 172, 173, 174, 175, 176, 177, 178, 179, 180, 181, 182, 183, 184, 185, 186, 187, 188, 190, 191, 192, 193, 194, 195, 197, 198, 199, 200, 201, 202, 203, 205, 207, 209, 211, 212, 213, 214, 215, 216, 217, 218, 219, 220, 221, 223, 224, 225, 227, 228, 229, 230, 231, 232, 233, 234, and 235.

D. Percent Identity

In some embodiments, an aluminum tolerance-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one of the amino acid sequences set forth in SEQ ID NOs: 2, 3, 4, 5, 7, 8, 9, 10, 11, 12, 13, 14, 15, 17, 19, 20, 22, 24, 26, 28, 29, 31, 32, 33, 35, 36, 38, 40, 41, 42, 43, 44, 45, 47, 48, 49, 50, 52, 54, 55, 56, 57, 58, 59, 61, 63, 64, 65, 66, 67, 69, 70, 72, 73, 75, 77, 78, 79, 81, 82, 83, 84, 85, 86, 87, 88, 89, 90, 91, 93, 94, 96, 97, 98, 99, 100, 102, 103, 104, 105, 106, 107, 108, 109, 110, 111, 113, 115, 117, 119, 120, 121, 122, 124, 125, 126, 127, 129, 131, 132, 134, 136, 137, 138, 140, 142, 144, 146, 147, 148, 149, 150, 151, 152, 153, 154, 155, 156, 158, 159, 160, 162, 163, 164, 166, 167, 169, 171, 172, 173, 174, 175, 176, 177, 178, 179, 180, 181, 182, 183, 184, 185, 186, 187, 188, 190, 191, 192, 193, 194, 195, 197, 198, 199, 200, 201, 202, 203, 205, 207, 209, 211, 212, 213, 214, 215, 216, 217, 218, 219, 220, 221, 223, 224, 225, 227, 228, 229, 230, 231, 232, 233, 234, 235, 237, 239, 241, 243, 245, 246, 248, 250, 251, 253, 255, 257, 258, 259, 261, 263, 265, 267, 269, 271, 273, 274, 276, 278, 280, 281, 283, 284, 285, 287, 288, 290, 292, 293, 294, 296, 298, 300, 302, 304, 306, 308, 310, 312, 314, 316, 318, 320, 322, 324, 326, 328, 329, 331, 333, 335, 337, 338, 339, 341, 342, 343, 344, 345, 346, 347, 348, 349, 350, 351, 353, 355, 357, 358, 360, 362, 364, 366, 368, 369, 371, 373, 375, 376, 377, 378, 379, 380, 382, 384, 386, 388, 390, 392, 393, 395, 396, 397, 398, 399, 400, 401, 402, 404, 405, 407, 409, 411, 413, 414, 416, 418, 420, 421, 423, 424, 425, 426, 428, 429, 431, 432, 433, 434, 435, 436, 437, 438, 439, 440, 441, 442, 443, 444, 445, 446, 447, 449, 451, 453, 454, 456, 457, 458, 459, 460, 461, 462, 463, 465, 467, 468, 469, 470, 471, 472, 473, 474, 475, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 535, 537, 539, 540, 542, 544, 545, 547, 549, 551, 553, 555, 557, 558, 560, 562, 564, 568, 570, 572, 574, 576, 578, 579, 580, 581, 583, 585, 587, 589, 591, 593, 595, 597, 599, 601, 603, 605, 607, 608, 610, 612, 614, 616, 618, 620, 622, 624, 625, 627, 629, 631, 633, 635, 637, 639, 641, 643, 645, 647, 649, 650, 651, 652, 653, 654, 655, 656, 657, 658, 660, 662, 664, 666, 668, 669, 670, 671, 672, 673, 674, 675, 676, 677, 679, 681, 683, 685, 686, 687, 689, 691, 693, 695, 696, 698, 699, 701, 702, 703, 704, 705, 706, 707, 709, 710, 711, 712, 713, 714, 715, 716, 717, 718, 719, 721, 722, 723, 724, 725, 726, 727, 728, 729, 730, 731, 732, 733, 734, 735, 736, 737, 738, 739, 740, 742, 744, 745, 746, 747, 749, 750, 752, 753, 754, 755, 757, 759, 760, 761, 762, 764, 765, 766, 767, 768, 769, 770, 771, and 772. Polypeptides having such a percent sequence identity often have a domain indicative of an aluminum tolerance-modulating polypeptide and/or have an HMM bit score that is greater than 65, as discussed above. Amino acid sequences of aluminum tolerance-modulating polypeptides having at least 80% sequence identity to one of the amino acid sequences set forth in SEQ ID NOs: 2, 3, 4, 5, 7, 8, 9, 10, 11, 12, 13, 14, 15, 17, 19, 20, 22, 24, 26, 28, 29, 31, 32, 33, 35, 36, 38, 40, 41, 42, 43, 44, 45, 47, 48, 49, 50, 52, 54, 55, 56, 57, 58, 59, 61, 63, 64, 65, 66, 67, 69, 70, 72, 73, 75, 77, 78, 79, 81, 82, 83, 84, 85, 86, 87, 88, 89, 90, 91, 93, 94, 96, 97, 98, 99, 100, 102, 103, 104, 105, 106, 107, 108, 109, 110, 111, 113, 115, 117, 119, 120, 121, 122, 124, 125, 126, 127, 129, 131, 132, 134, 136, 137, 138, 140, 142, 144, 146, 147, 148, 149, 150, 151, 152, 153, 154, 155, 156, 158, 159, 160, 162, 163, 164, 166, 167, 169, 171, 172, 173, 174, 175, 176, 177, 178, 179, 180, 181, 182, 183, 184, 185, 186, 187, 188, 190, 191, 192, 193, 194, 195, 197, 198, 199, 200, 201, 202, 203, 205, 207, 209, 211, 212, 213, 214, 215, 216, 217, 218, 219, 220, 221, 223, 224, 225, 227, 228, 229, 230, 231, 232, 233, 234, 235, 237, 239, 241, 243, 245, 246, 248, 250, 251, 253, 255, 257, 258, 259, 261, 263, 265, 267, 269, 271, 273, 274, 276, 278, 280, 281, 283, 284, 285, 287, 288, 290, 292, 293, 294, 296, 298, 300, 302, 304, 306, 308, 310, 312, 314, 316, 318, 320, 322, 324, 326, 328, 329, 331, 333, 335, 337, 338, 339, 341, 342, 343, 344, 345, 346, 347, 348, 349, 350, 351, 353, 355, 357, 358, 360, 362, 364, 366, 368, 369, 371, 373, 375, 376, 377, 378, 379, 380, 382, 384, 386, 388, 390, 392, 393, 395, 396, 397, 398, 399, 400, 401, 402, 404, 405, 407, 409, 411, 413, 414, 416, 418, 420, 421, 423, 424, 425, 426, 428, 429, 431, 432, 433, 434, 435, 436, 437, 438, 439, 440, 441, 442, 443, 444, 445, 446, 447, 449, 451, 453, 454, 456, 457, 458, 459, 460, 461, 462, 463, 465, 467, 468, 469, 470, 471, 472, 473, 474, 475, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 535, 537, 539, 540, 542, 544, 545, 547, 549, 551, 553, 555, 557, 558, 560, 562, 564, 568, 570, 572, 574, 576, 578, 579, 580, 581, 583, 585, 587, 589, 591, 593, 595, 597, 599, 601, 603, 605, 607, 608, 610, 612, 614, 616, 618, 620, 622, 624, 625, 627, 629, 631, 633, 635, 637, 639, 641, 643, 645, 647, 649, 650, 651, 652, 653, 654, 655, 656, 657, 658, 660, 662, 664, 666, 668, 669, 670, 671, 672, 673, 674, 675, 676, 677, 679, 681, 683, 685, 686, 687, 689, 691, 693, 695, 696, 698, 699, 701, 702, 703, 704, 705, 706, 707, 709, 710, 711, 712, 713, 714, 715, 716, 717, 718, 719, 721, 722, 723, 724, 725, 726, 727, 728, 729, 730, 731, 732, 733, 734, 735, 736, 737, 738, 739, 740, 742, 744, 745, 746, 747, 749, 750, 752, 753, 754, 755, 757, 759, 760, 761, 762, 764, 765, 766, 767, 768, 769, 770, 771, and 772 are provided in FIGS. 1-4 and in the Sequence Listing.

"Percent sequence identity" refers to the degree of sequence identity between any given reference sequence, e.g., SEQ ID NO: 1, and a candidate aluminum tolerance-modulating sequence. A candidate sequence typically has a length that is from 80 percent to 200 percent of the length of the reference sequence, e.g., 82, 85, 87, 89, 90, 93, 95, 97, 99, 100, 105, 110, 115, 120, 130, 140, 150, 160, 170, 180, 190, or 200 percent of the length of the reference sequence. A percent identity for any candidate nucleic acid or polypeptide relative to a reference nucleic acid or polypeptide can be determined as follows. A reference sequence (e.g., a nucleic acid sequence or an amino acid sequence) is aligned to one or more candidate sequences using the computer program ClustalW (version 1.83, default parameters), which allows alignments of nucleic acid or polypeptide sequences to be carried out across their entire length (global alignment). Chema et al., Nucleic Acids Res., 31(13):3497-500 (2003).

ClustalW calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site on the World Wide Web (searchlauncher.bcm.tmc.edu/multi-align/multi-align.html) and at the European Bioinformatics Institute site on the World Wide Web (ebi.ac.uk/clustalw).

To determine percent identity of a candidate nucleic acid or amino acid sequence to a reference sequence, the sequences are aligned using ClustalW, the number of identical matches in the alignment is divided by the length of the reference sequence, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

In some cases, an aluminum tolerance-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 353. Amino acid sequences of polypeptides having greater than 45% sequence identity to the polypeptide set forth in SEQ ID NO: 353 are provided in FIG. 1 and in the Sequence Listing.

In some cases, an aluminum tolerance-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 237. Amino acid sequences of polypeptides having greater than 45% sequence identity to the polypeptide set forth in SEQ ID NO: 237 are provided in FIG. 2 and in the Sequence Listing.

In some cases, an aluminum tolerance-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 451. Amino acid sequences of polypeptides having greater than 45% sequence identity to the polypeptide set forth in SEQ ID NO: 451 are provided in FIG. 3 and in the Sequence Listing.

In some cases, an aluminum tolerance-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 2. Amino acid sequences of polypeptides having greater than 45% sequence identity to the polypeptide set forth in SEQ ID NO: 2 are provided in FIG. 4 and in the Sequence Listing.

E. Other Sequences

It should be appreciated that an aluminum tolerance-modulating polypeptide can include additional amino acids that are not involved in aluminum tolerance modulation, and thus such a polypeptide can be longer than would otherwise be the case. For example, an aluminum tolerance-modulating polypeptide can include a purification tag, a chloroplast transit peptide, a mitochondrial transit peptide, an amyloplast peptide, or a leader sequence added to the amino or carboxy terminus. In some embodiments, an aluminum tolerance-modulating polypeptide includes an amino acid sequence that functions as a reporter, e.g., a green fluorescent protein or yellow fluorescent protein.

III. Nucleic Acids

Nucleic acids described herein include nucleic acids that are effective to modulate aluminum tolerance levels when transcribed in a plant or plant cell. Such nucleic acids include, without limitation, those that encode an aluminum tolerance-modulating polypeptide and those that can be used to inhibit expression of an aluminum tolerance-modulating polypeptide via a nucleic acid based method.

A. Nucleic Acids Encoding Aluminum Tolerance-Modulating Polypeptides

Nucleic acids encoding aluminum tolerance-modulating polypeptides are described herein. Examples of such nucleic acids include SEQ ID NOs: 1, 6, 16, 18, 21, 23, 25, 27, 30, 34, 37, 39, 46, 51, 53, 60, 62, 68, 71, 74, 76, 80, 92, 95, 101, 112, 114, 116, 118, 123, 128, 130, 133, 135, 139, 141, 143, 145, 157, 161, 165, 168, 170, 189, 196, 204, 206, 208, 210, 222, 226, 236, 238, 240, 242, 244, 247, 249, 252, 254, 256, 260, 262, 264, 266, 268, 270, 272, 275, 277, 279, 282, 286, 289, 291, 295, 297, 299, 301, 303, 305, 307, 309, 311, 313, 315, 317, 319, 321, 323, 325, 327, 330, 332, 334, 336, 340, 352, 354, 356, 359, 361, 363, 365, 367, 370, 372, 374, 381, 383, 385, 387, 389, 391, 394, 403, 406, 408, 410, 412, 415, 417, 419, 422, 427, 430, 448, 450, 452, 455, 464, 466, 477, 479, 481, 483, 485, 487, 489, 491, 493, 495, 497, 499, 501, 503, 505, 507, 509, 511, 513, 515, 517, 519, 521, 523, 525, 527, 529, 531, 533, 536, 538, 541, 543, 546, 548, 550, 552, 554, 556, 559, 561, 563, 567, 569, 571, 573, 575, 577, 582, 584, 586, 588, 590, 592, 594, 596, 598, 600, 602, 604, 606, 609, 611, 613, 615, 617, 619, 621, 623, 626, 628, 630, 632, 634, 636, 638, 640, 642, 644, 646, 648, 659, 661, 663, 665, 667, 678, 680, 682, 684, 688, 690, 692, 694, 697, 700, 708, 720, 741, 743, 748, 751, 756, 758, and 763 as described in more detail below. A nucleic acid also can be a fragment that is at least 40% (e.g., at least 45, 50, 55, 60, 65, 70, 75, 80, 85, 90, 95, or 99%) of the length of the full-length nucleic acid set forth in SEQ ID NOs: 1, 6, 16, 18, 21, 23, 25, 27, 30, 34, 37, 39, 46, 51, 53, 60, 62, 68, 71, 74, 76, 80, 92, 95, 101, 112, 114, 116, 118, 123, 128, 130, 133, 135, 139, 141, 143, 145, 157, 161, 165, 168, 170, 189, 196, 204, 206, 208, 210, 222, 226, 236, 238, 240, 242, 244, 247, 249, 252, 254, 256, 260, 262, 264, 266, 268, 270, 272, 275, 277, 279, 282, 286, 289, 291, 295, 297, 299, 301, 303, 305, 307, 309, 311, 313, 315, 317, 319, 321, 323, 325, 327, 330, 332, 334, 336, 340, 352, 354, 356, 359, 361, 363, 365, 367, 370, 372, 374, 381, 383, 385, 387, 389, 391, 394, 403, 406, 408, 410, 412, 415, 417, 419, 422, 427, 430, 448, 450, 452, 455, 464, 466, 477, 479, 481, 483, 485, 487, 489, 491, 493, 495, 497, 499, 501, 503, 505, 507, 509, 511, 513, 515, 517, 519, 521, 523, 525, 527, 529, 531, 533, 536, 538, 541, 543, 546, 548, 550, 552, 554, 556, 559, 561, 563, 567, 569, 571, 573, 575, 577, 582, 584, 586, 588, 590, 592, 594, 596, 598, 600, 602, 604, 606, 609, 611, 613, 615, 617, 619, 621, 623, 626, 628, 630, 632, 634, 636, 638, 640, 642, 644, 646, 648, 659, 661, 663, 665, 667, 678, 680, 682, 684, 688, 690, 692, 694, 697, 700, 708, 720, 741, 743, 748, 751, 756, 758, and 763.

An aluminum tolerance-modulating nucleic acid can comprise the nucleotide sequence set forth in SEQ ID NO:352. Alternatively, an aluminum tolerance-modulating nucleic acid can be a variant of the nucleic acid having the nucleotide sequence set forth in SEQ ID NO: 352. For example, an aluminum tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 352.

An aluminum tolerance-modulating nucleic acid can comprise the nucleotide sequence set forth in SEQ ID NO: 236. Alternatively, an aluminum tolerance-modulating nucleic acid can be a variant of the nucleic acid having the nucleotide sequence set forth in SEQ ID NO: 236. For example, an aluminum tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 236.

An aluminum tolerance-modulating nucleic acid can comprise the nucleotide sequence set forth in SEQ ID NO: 450. Alternatively, an aluminum tolerance-modulating nucleic acid can be a variant of the nucleic acid having the nucleotide sequence set forth in SEQ ID NO: 450. For example, an aluminum tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 450.

An aluminum tolerance-modulating nucleic acid can comprise the nucleotide sequence set forth in SEQ ID NO: 1. Alternatively, an aluminum tolerance-modulating nucleic acid can be a variant of the nucleic acid having the nucleotide sequence set forth in SEQ ID NO: 1. For example, an aluminum tolerance-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 1.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in *PCR Primer: A Laboratory Manual*, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

B. Use of Nucleic Acids to Modulate Expression of Polypeptides i. Expression of an Aluminum Tolerance-Modulating Polypeptide A nucleic acid encoding one of the aluminum tolerance-modulating polypeptides described herein can be used to express the polypeptide in a plant species of interest, typically by transforming a plant cell with a nucleic acid having the coding sequence for the polypeptide operably linked in sense orientation to one or more regulatory regions. It will be appreciated that because of the degeneracy of the genetic code, a number of nucleic acids can encode a particular aluminum tolerance-modulating polypeptide; i.e., for many amino acids, there is more than one nucleotide triplet that serves as the codon for the amino acid. Thus, codons in the coding sequence for a given aluminum tolerance-modulating polypeptide can be modified such that optimal expression in a particular plant species is obtained, using appropriate codon bias tables for that species.

In some cases, expression of an aluminum tolerance-modulating polypeptide inhibits one or more functions of an endogenous polypeptide. For example, a nucleic acid that encodes a dominant negative polypeptide can be used to inhibit protein function. A dominant negative polypeptide typically is mutated or truncated relative to an endogenous wild type polypeptide, and its presence in a cell inhibits one or more functions of the wild type polypeptide in that cell, i.e., the dominant negative polypeptide is genetically dominant and confers a loss of function. The mechanism by which a dominant negative polypeptide confers such a phenotype can vary but often involves a protein-protein interaction or a protein-DNA interaction. For example, a dominant negative polypeptide can be an enzyme that is truncated relative to a native wild type enzyme, such that the truncated polypeptide retains domains involved in binding a first protein but lacks domains involved in binding a second protein. The truncated polypeptide is thus unable to properly modulate the activity of the second protein. See, e.g., US 2007/0056058. As another example, a point mutation that results in a non-conservative amino acid substitution in a catalytic domain can result in a dominant negative polypeptide. See, e.g., US 2005/032221. As another example, a dominant negative polypeptide can be a transcription factor that is truncated relative to a native wild type transcription factor, such that the truncated polypeptide retains the DNA binding domain(s) but lacks the activation domain(s). Such a truncated polypeptide can inhibit the wild type transcription factor from binding DNA, thereby inhibiting transcription activation.

ii. Inhibition of Expression of an Aluminum Tolerance-Modulating Polypeptide

Polynucleotides and recombinant constructs described herein can be used to inhibit expression of an aluminum tolerance-modulating polypeptide in a plant species of interest. See, e.g., Matzke and Birchler, *Nature Reviews Genetics* 6:24-35 (2005); Akashi et al., *Nature Reviews Mol. Cell. Biology* 6:413-422 (2005); Mittal, *Nature Reviews Genetics* 5:355-365 (2004); and Nature Reviews RNA interference collection, October 2005 on the World Wide Web at nature.com/reviews/focus/mai. A number of nucleic acid based methods, including antisense RNA, ribozyme directed RNA cleavage, post-transcriptional gene silencing (PTGS), e.g., RNA interference (RNAi), and transcriptional gene silencing (TGS) are known to inhibit gene expression in plants. Suitable polynucleotides include full-length nucleic acids encoding aluminum tolerance-modulating polypeptides or fragments of such full-length nucleic acids. In some embodiments, a complement of the full-length nucleic acid or a fragment thereof can be used. Typically, a fragment is at least 10 nucleotides, e.g., at least 12, 13, 14, 15, 16, 17, 18, 19, 20, 21, 22, 23, 24, 25, 26, 27, 30, 35, 40, 50, 80, 100, 200, 500 nucleotides or more. Generally, higher homology can be used to compensate for the use of a shorter sequence.

Antisense technology is one well-known method. In this method, a nucleic acid of a gene to be repressed is cloned and operably linked to a regulatory region and a transcription termination sequence so that the antisense strand of RNA is transcribed. The recombinant construct is then transformed into plants, as described herein, and the antisense strand of RNA is produced. The nucleic acid need not be the entire sequence of the gene to be repressed, but typically will be substantially complementary to at least a portion of the sense strand of the gene to be repressed.

In another method, a nucleic acid can be transcribed into a ribozyme, or catalytic RNA, that affects expression of an mRNA. See, U.S. Pat. No. 6,423,885. Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contains a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman et al., *Proc. Natl. Acad. Sci. USA*, 92(13):6175-6179 (1995); de Feyter and Gaudron, Methods in Molecular Biology, Vol. 74, Chapter 43, "Expressing Ribozymes in Plants", Edited by Turner, P.C., Humana Press Inc., Totowa, N.J. RNA endoribonucleases which have been described, such as the one that occurs naturally in *Tetrahymena thermophile*, can be useful. See, for example, U.S. Pat. Nos. 4,987,071 and 6,423,885.

PTGS, e.g., RNAi, can also be used to inhibit the expression of a gene. For example, a construct can be prepared that includes a sequence that is transcribed into an RNA that can anneal to itself, e.g., a double stranded RNA having a stem-loop structure. In some embodiments, one strand of the stem portion of a double stranded RNA comprises a sequence that is similar or identical to the sense coding sequence or a fragment thereof of an aluminum tolerance-modulating polypeptide, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand or a fragment thereof of the coding sequence of the aluminum tolerance-modulating polypeptide, and can have a length that is shorter, the same as, or longer than the corresponding length of the sense sequence. In some cases, one strand of the stem portion of a double stranded RNA comprises a sequence that is similar or identical to the 3' or 5' untranslated region, or a fragment thereof, of an mRNA encoding an aluminum tolerance-modulating polypeptide, and the other strand of the stem portion of the double stranded RNA comprises a sequence that is similar or identical to the sequence that is complementary to the 3' or 5' untranslated region, respectively, or a fragment thereof, of the mRNA encoding the aluminum tolerance-modulating polypeptide. In other embodiments, one strand of the stem portion of a double stranded RNA comprises a sequence that is similar or identical to the sequence of an intron, or a fragment thereof, in the pre-mRNA encoding an aluminum tolerance-modulating polypeptide, and the other strand of the stem portion comprises a sequence that is similar or identical to the sequence that is complementary to the sequence of the intron, or a fragment thereof, in the pre-mRNA.

The loop portion of a double stranded RNA can be from 3 nucleotides to 5,000 nucleotides, e.g., from 3 nucleotides to 25 nucleotides, from 15 nucleotides to 1,000 nucleotides, from 20 nucleotides to 500 nucleotides, or from 25 nucleotides to 200 nucleotides. The loop portion of the RNA can include an intron or a fragment thereof. A double stranded RNA can have zero, one, two, three, four, five, six, seven, eight, nine, ten, or more stem-loop structures.

A construct including a sequence that is operably linked to a regulatory region and a transcription termination sequence, and that is transcribed into an RNA that can form a double stranded RNA, is transformed into plants as described herein. Methods for using RNAi to inhibit the expression of a gene are known to those of skill in the art. See, e.g., U.S. Pat. Nos. 5,034,323; 6,326,527; 6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

Constructs containing regulatory regions operably linked to nucleic acid molecules in sense orientation can also be used to inhibit the expression of a gene. The transcription product can be similar or identical to the sense coding sequence, or a fragment thereof, of an aluminum tolerance-modulating polypeptide. The transcription product also can be unpolyadenylated, lack a 5' cap structure, or contain an unspliceable intron. Methods of inhibiting gene expression using a full-length cDNA as well as a partial cDNA sequence are known in the art. See, e.g., U.S. Pat. No. 5,231,020.

In some embodiments, a construct containing a nucleic acid having at least one strand that is a template for both sense and antisense sequences that are complementary to each other is used to inhibit the expression of a gene. The sense and antisense sequences can be part of a larger nucleic acid molecule or can be part of separate nucleic acid molecules having sequences that are not complementary. The sense or antisense sequence can be a sequence that is identical or complementary to the sequence of an mRNA, the 3' or 5' untranslated region of an mRNA, or an intron in a pre-mRNA encoding an aluminum tolerance-modulating polypeptide, or a fragment of such sequences. In some embodiments, the sense or antisense sequence is identical or complementary to a sequence of the regulatory region that drives transcription of the gene encoding an aluminum tolerance-modulating polypeptide. In each case, the sense sequence is the sequence that is complementary to the antisense sequence.

The sense and antisense sequences can be a length greater than about 10 nucleotides (e.g., 12, 13, 14, 15, 16, 17, 18, 19, 20, 21, 22, 23, 24, 25, 26, 27, 28, 29, 30, or more nucleotides). For example, an antisense sequence can be 21 or 22 nucleotides in length. Typically, the sense and antisense sequences range in length from about 15 nucleotides to about 30 nucleotides, e.g., from about 18 nucleotides to about 28 nucleotides, or from about 21 nucleotides to about 25 nucleotides.

In some embodiments, an antisense sequence is a sequence complementary to an mRNA sequence, or a fragment thereof, encoding an aluminum tolerance-modulating polypeptide described herein. The sense sequence complementary to the antisense sequence can be a sequence present within the mRNA of the aluminum tolerance-modulating polypeptide. Typically, sense and antisense sequences are designed to correspond to a 15-30 nucleotide sequence of a target mRNA such that the level of that target mRNA is reduced.

In some embodiments, a construct containing a nucleic acid having at least one strand that is a template for more than one sense sequence (e.g., 2, 3, 4, 5, 6, 7, 8, 9, 10 or more sense sequences) can be used to inhibit the expression of a gene. Likewise, a construct containing a nucleic acid having at least one strand that is a template for more than one antisense sequence (e.g., 2, 3, 4, 5, 6, 7, 8, 9, 10 or more antisense sequences) can be used to inhibit the expression of a gene. For example, a construct can contain a nucleic acid having at least one strand that is a template for two sense sequences and two antisense sequences. The multiple sense sequences can be identical or different, and the multiple antisense sequences can be identical or different. For example, a construct can have a nucleic acid having one strand that is a template for two identical sense sequences and two identical antisense sequences that are complementary to the two identical sense sequences. Alternatively, an isolated nucleic acid can have one strand that is a template for (1) two identical sense sequences 20 nucleotides in length, (2) one antisense sequence that is complementary to the two identical sense sequences 20 nucleotides in length, (3) a sense sequence 30 nucleotides in length, and (4) three identical antisense sequences that are complementary to the sense sequence 30 nucleotides in length. The constructs provided herein can be designed to have a suitable arrangement of sense and antisense sequences. For example, two identical sense sequences can be followed by two identical antisense sequences or can be positioned between two identical antisense sequences.

A nucleic acid having at least one strand that is a template for one or more sense and/or antisense sequences can be operably linked to a regulatory region to drive transcription of an RNA molecule containing the sense and/or antisense sequence(s). In addition, such a nucleic acid can be operably linked to a transcription terminator sequence, such as the terminator of the nopaline synthase (nos) gene. In some cases, two regulatory regions can direct transcription of two transcripts: one from the top strand, and one from the bottom strand. See, for example, Yan et al., *Plant Physiol.*, 141: 1508-1518 (2006). The two regulatory regions can be the same or different. The two transcripts can form double-stranded RNA molecules that induce degradation of the target RNA. In some cases, a nucleic acid can be positioned within a T-DNA or plant-derived transfer DNA (P-DNA) such that the left and right T-DNA border sequences or the left and right border-like sequences of the P-DNA flank, or are on either side of, the nucleic acid. See, U.S. Patent Publication No. 2006/0265788. The nucleic acid sequence between the two regulatory regions can be from about 15 to about 300 nucleotides in length. In some embodiments, the nucleic acid sequence between the two regulatory regions is from about 15 to about 200 nucleotides in length, from about 15 to about 100 nucleotides in length, from about 15 to about 50 nucleotides in length, from about 18 to about 50 nucleotides in length, from about 18 to about 40 nucleotides in length, from about 18 to about 30 nucleotides in length, or from about 18 to about 25 nucleotides in length.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, *Antisense Nucleic Acid Drug Dev.*, 7:187-195 (1997); Hyrup et al., *Bioorgan. Med. Chem.*, 4:5-23 (1996). In addition, the deoxyphosphate backbone can be replaced with, for example, a phosphorothioate or phosphorodithioate backbone, a phosphoroamidite, or an alkyl phosphotriester backbone.

C. Constructs/Vectors

Recombinant constructs provided herein can be used to transform plants or plant cells in order to modulate aluminum tolerance levels. A recombinant nucleic acid construct can comprise a nucleic acid encoding an aluminum tolerance-modulating polypeptide as described herein, operably linked to a regulatory region suitable for expressing the aluminum tolerance-modulating polypeptide in the plant or cell. Thus, a nucleic acid can comprise a coding sequence that encodes an aluminum tolerance-modulating polypeptide as set forth in SEQ ID NOs: 2, 3, 4, 5, 7, 8, 9, 10, 11, 12, 13, 14, 15, 17, 19, 20, 22, 24, 26, 28, 29, 31, 32, 33, 35, 36, 38, 40, 41, 42, 43, 44, 45, 47, 48, 49, 50, 52, 54, 55, 56, 57, 58, 59, 61, 63, 64, 65, 66, 67, 69, 70, 72, 73, 75, 77, 78, 79, 81, 82, 83, 84, 85, 86, 87, 88, 89, 90, 91, 93, 94, 96, 97, 98, 99, 100, 102, 103, 104, 105, 106, 107, 108, 109, 110, 111, 113, 115, 117, 119, 120, 121, 122, 124, 125, 126, 127, 129, 131, 132, 134, 136, 137, 138, 140, 142, 144, 146, 147, 148, 149, 150, 151, 152, 153, 154, 155, 156, 158, 159, 160, 162, 163, 164, 166, 167, 169, 171, 172, 173, 174, 175, 176, 177, 178, 179, 180, 181, 182, 183, 184, 185, 186, 187, 188, 190, 191, 192, 193, 194, 195, 197, 198, 199, 200, 201, 202, 203, 205, 207, 209, 211, 212, 213, 214, 215, 216, 217, 218, 219, 220, 221, 223, 224, 225, 227, 228, 229, 230, 231, 232, 233, 234, 235, 237, 239, 241, 243, 245, 246, 248, 250, 251, 253, 255, 257, 258, 259, 261, 263, 265, 267, 269, 271, 273, 274, 276, 278, 280, 281, 283, 284, 285, 287, 288, 290, 292, 293, 294, 296, 298, 300, 302, 304, 306, 308, 310, 312, 314, 316, 318, 320, 322, 324, 326, 328, 329, 331, 333, 335, 337, 338, 339, 341, 342, 343, 344, 345, 346, 347, 348, 349, 350, 351, 353, 355, 357, 358, 360, 362, 364, 366, 368, 369, 371, 373, 375, 376, 377, 378, 379, 380, 382, 384, 386, 388, 390, 392, 393, 395, 396, 397, 398, 399, 400, 401, 402, 404, 405, 407, 409, 411, 413, 414, 416, 418, 420, 421, 423, 424, 425, 426, 428, 429, 431, 432, 433, 434, 435, 436, 437, 438, 439, 440, 441, 442, 443, 444, 445, 446, 447, 449, 451, 453, 454, 456, 457, 458, 459, 460, 461, 462, 463, 465, 467, 468, 469, 470, 471, 472, 473, 474, 475, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 535, 537, 539, 540, 542, 544, 545, 547, 549, 551, 553, 555, 557, 558, 560, 562, 564, 568, 570, 572, 574, 576, 578, 579, 580, 581, 583, 585, 587, 589, 591, 593, 595, 597, 599, 601, 603, 605, 607, 608, 610, 612, 614, 616, 618, 620, 622, 624, 625, 627, 629, 631, 633, 635, 637, 639, 641, 643, 645, 647, 649, 650, 651, 652, 653, 654, 655, 656, 657, 658, 660, 662, 664, 666, 668, 669, 670, 671, 672, 673, 674, 675, 676, 677, 679, 681, 683, 685, 686, 687, 689, 691, 693, 695, 696, 698, 699, 701, 702, 703, 704, 705, 706, 707, 709, 710, 711, 712, 713, 714, 715, 716, 717, 718, 719, 721, 722, 723, 724, 725, 726, 727, 728, 729, 730, 731, 732, 733, 734, 735, 736, 737, 738, 739, 740, 742, 744, 745, 746, 747, 749, 750, 752, 753, 754, 755, 757, 759, 760, 761, 762, 764, 765, 766, 767, 768, 769, 770, 771, and 772. Examples of nucleic acids encoding aluminum tolerance-modulating polypeptides are set forth in SEQ ID NOs: 1, 6, 16, 18, 21, 23, 25, 27, 30, 34, 37, 39, 46, 51, 53, 60, 62, 68, 71, 74, 76, 80, 92, 95, 101, 112, 114, 116, 118, 123, 128, 130, 133, 135, 139, 141, 143, 145, 157, 161, 165, 168, 170, 189, 196, 204, 206, 208, 210, 222, 226, 236, 238, 240, 242, 244, 247, 249, 252, 254, 256, 260, 262, 264, 266, 268, 270, 272, 275, 277, 279, 282, 286, 289, 291, 295, 297, 299, 301, 303, 305, 307, 309, 311, 313, 315, 317, 319, 321, 323, 325, 327, 330, 332, 334, 336, 340, 352, 354, 356, 359, 361, 363, 365, 367, 370, 372, 374, 381, 383, 385, 387, 389, 391, 394, 403, 406, 408, 410, 412, 415, 417, 419, 422, 427, 430, 448, 450, 452, 455, 464, 466, 477, 479, 481, 483, 485, 487, 489, 491, 493, 495, 497, 499, 501, 503, 505, 507, 509, 511, 513, 515, 517, 519, 521, 523, 525, 527, 529, 531, 533, 536, 538, 541, 543, 546, 548, 550, 552, 554, 556, 559, 561, 563, 567, 569, 571, 573, 575, 577, 582, 584, 586, 588, 590, 592, 594, 596, 598, 600, 602, 604, 606, 609, 611, 613, 615, 617, 619, 621, 623, 626, 628, 630, 632, 634, 636, 638, 640, 642, 644, 646, 648, 659, 661, 663, 665, 667, 678, 680, 682, 684, 688, 690, 692, 694, 697, 700, 708, 720, 741, 743, 748, 751, 756, 758, and 763, or in the Sequence Listing. The aluminum tolerance-modulating polypeptide encoded by a recombinant nucleic acid can be a native aluminum tolerance-modulating polypeptide, or can be heterologous to the cell. In some cases, the recombinant construct contains a nucleic acid that inhibits expression of an aluminum tolerance-modulating polypeptide, operably linked to a regulatory region. Examples of suitable regulatory regions are described in the section entitled "Regulatory Regions."

Vectors containing recombinant nucleic acid constructs such as those described herein also are provided. Suitable vector backbones include, for example, those routinely used in the art such as plasmids, viruses, artificial chromosomes, BACs, YACs, or PACs. Suitable expression vectors include, without limitation, plasmids and viral vectors derived from, for example, bacteriophage, baculoviruses, and retroviruses. Numerous vectors and expression systems are commercially available from such corporations as Novagen® (Madison, Wis.), Clontech® (Palo Alto, Calif.), Stratagene® (La Jolla, Calif.), and Invitrogen/Life Technologies® (Carlsbad, Calif.).

The vectors provided herein also can include, for example, origins of replication, selectable phenotype on a plant cell. For example, a marker can confer biocide scaffold attachment regions (SARs), and/or markers. A marker gene can confer a resistance, such as resistance to an antibiotic (e.g., kanamycin, G418, bleomycin, or hygromycin), or an herbicide (e.g., glyphosate, chlorsulfuron or phosphinothricin). In addition, an expression vector can include a tag sequence designed to facilitate manipulation or detection (e.g., purification or localization) of the expressed polypeptide. Tag sequences, such as luciferase, β-glucuronidase (GUS), green fluorescent protein (GFP), glutathione S-transferase (GST), polyhistidine, c-myc, hemagglutinin, or Flag™ tag (Kodak, New Haven, Conn.) sequences typically are expressed as a fusion with the encoded polypeptide. Such tags can be inserted anywhere within the polypeptide, including at either the carboxyl or amino terminus.

D. Regulatory Regions

The choice of regulatory regions to be included in a recombinant construct depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence. Transcription of a nucleic acid can be modulated in a similar manner.

Some suitable regulatory regions initiate transcription only, or predominantly, in certain cell types. Methods for identifying and characterizing regulatory regions in plant genomic DNA are known, including, for example, those described in the following references: Jordano et al., *Plant Cell*, 1:855-866 (1989); Bustos et al., *Plant Cell*, 1:839-854 (1989); Green et al., *EMBO J.*, 7:4035-4044 (1988); Meier et al., *Plant Cell*, 3:309-316 (1991); and Zhang et al., *Plant Physiology*, 110:1069-1079 (1996).

Examples of various classes of regulatory regions are described below. Some of the regulatory regions indicated below as well as additional regulatory regions are described in more detail in U.S. Patent Application Ser. Nos. 60/505,689; 60/518,075; 60/544,771; 60/558,869; 60/583,691; 60/619,181; 60/637,140; 60/757,544; 60/776,307; 10/957,569; 11/058,689; 11/172,703; 11/208,308; 11/274,890; 60/583,609; 60/612,891; 11/097,589; 11/233,726; 11/408,791; 11/414,142; 10/950,321; 11/360,017; PCT/US05/011105; PCT/US05/23639; PCT/US05/034308; PCT/US05/034343; and PCT/US06/038236; PCT/US06/040572; PCT/US07/62762; PCT/US2009/032485; and PCT/US2009/038792.

For example, the sequences of regulatory regions p326, YP0144, YP0190, p13879, YP0050, p32449, 21876, YP0158, YP0214, YP0380, PT0848, PT0633, YP0128, YP0275, PT0660, PT0683, PT0758, PT0613, PT0672, PT0688, PT0837, YP0092, PT0676, PT0708, YP0396, YP0007, YP0111, YP0103, YP0028, YP0121, YP0008, YP0039, YP0115, YP0119, YP0120, YP0374, YP0101, YP0102, YP0110, YP0117, YP0137, YP0285, YP0212, YP0097, YP0107, YP0088, YP0143, YP0156, PT0650, PT0695, PT0723, PT0838, PT0879, PT0740, PT0535, PT0668, PT0886, PT0585, YP0381, YP0337, PT0710, YP0356, YP0385, YP0384, YP0286, YP0377, PD1367, PT0863, PT0829, PT0665, PT0678, YP0086, YP0188, YP0263, PT0743 and YP0096 are set forth in the sequence listing of PCT/US06/040572; the sequence of regulatory region PT0625 is set forth in the sequence listing of PCT/US05/034343; the sequences of regulatory regions PT0623, YP0388, YP0087, YP0093, YP0108, YP0022 and YP0080 are set forth in the sequence listing of U.S. patent application Ser. No. 11/172,703; the sequence of regulatory region PRO924 is set forth in the sequence listing of PCT/US07/62762; and the sequences of regulatory regions p530c10, pOsFIE2-2, pOsMEA, pOsYp102, and pOsYp285 are set forth in the sequence listing of PCT/US06/038236.

It will be appreciated that a regulatory region may meet criteria for one classification based on its activity in one plant species, and yet meet criteria for a different classification based on its activity in another plant species.

i. Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326, YP0144, YP0190, p13879, YP0050, p32449, 21876, YP0158, YP0214, YP0380, PT0848, and PT0633 promoters. Additional examples include the cauliflower mosaic virus (CaMV) $^{35}$S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV $^{35}$S promoter is excluded from the category of broadly expressing promoters.

Another example of a broad promoter is the sequence of regulatory region PD3141 set forth in the sequence listing of PCT/US2009/032485. Therein, the expression pattern of the PD3141 regulatory region is described for T0 rice plants overexpressing a construct comprising PD3141 driving expression of EGFP. In seedlings, expression was observed in: Tiller: not-specific; Main culm: not-specific; Root: not-specific; Leaf: not-specific; and Meristem: not-specific. In mature plants, expression was observed in: Main culm: bundle sheath, endodermis, epidermis, internode, ligule, node, pericycle, phloem, sclerenchyma layer, vasculature, xylem; Root: cortex, vascular; Panicle: flag leaf, ovary, peduncle, primary branch, rachilla, rachis, spiklet; Spiklet: flag leaf, floret(palea), lemma, ovule, pedicle, pollen, seed, stigma; Leaf: epidermis, leaf blade, leaf sheath, mesophyll; and Meristem: floral meristem, shoot apical meristem, vegetative meristem.

Another example of a broad promoter is the sequence of regulatory region p326 set forth in the sequence listing of U.S. application Ser. No. 10/981,334. Therein, the expression pattern of the p326 regulatory region is described for *Arabidopsis* plants. p326 expressed throughout most mature tissues screened. Expression was somewhat higher in epidermal, vascular and photosynthetic tissue of seedling. Lines characterized went through several generations.

Another example of a broad promoter is the sequence of regulatory region PD2995 (a 600 bp version of p326) set forth in the sequence listing of PCT/US2009/32485. In T0 rice plants, PD2995 expresses very weakly throughout all tissues of the plant in both seedling and mature stages. Strongest expression detected in root tissue and embryo.

ii. Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128, YP0275, PT0625, PT0660, PT0683, and PT0758 promoters. Other root-preferential promoters include the PT0613, PT0672, PT0688, and PT0837 promoters, which drive transcription primarily in root tissue and to a lesser extent in ovules and/or seeds. Other examples of root-preferential promoters include the root-specific subdomains of the CaMV $^{35}$S promoter (Lam et al., *Proc. Natl. Acad. Sci. USA*, 86:7890-7894 (1989)), root cell specific promoters reported by Conkling et al., *Plant Physiol.*, 93:1203-1211 (1990), and the tobacco RD2 promoter.

Another example of a root promoter is the sequence of regulatory region PD3561 set forth in the sequence listing of PCT/US2009/038792. Therein, the expression pattern of the PD3561 regulatory region is described for T0 rice plants overexpressing a construct comprising PD3561 driving expression of EGFP. Expression was observed in roots of seedlings in the cortex, epidermis, and vascular tissues. In mature plants, expression was observed strongly throughout the root with the exception of the root cap and in the cortex, epidermis, and vascular tissues.

iii. Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., Plant Cell, 1(9):839-853 (1989)), the soybean trypsin inhibitor promoter (Riggs et al., Plant Cell, 1(6):609-621 (1989)), the ACP promoter (Baerson et al., Plant Mol. Biol., 22(2):255-267 (1993)), the stearoyl-ACP desaturase promoter (Slocombe et al., Plant Physiol., 104(4):167-176 (1994)), the soybean a' subunit of β-conglycinin promoter (Chen et al., Proc. Natl. Acad. Sci. USA, 83:8560-8564 (1986)), the oleosin promoter (Hong et al., Plant Mol. Biol., 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., Mol. Cell. Biol., 13:5829-5842 (1993)), the beta-amylase promoter, and the barley hordein promoter. Other maturing endosperm promoters include the YP0092, PT0676, and PT0708 promoters.

iv. Ovary Tissue Promoters

Promoters that are active in ovary tissues such as the ovule wall and mesocarp can also be useful, e.g., a polygalacturonidase promoter, the banana TRX promoter, the melon actin promoter, YP0396, and PT0623. Examples of promoters that are active primarily in ovules include YP0007, YP0111, YP0092, YP0103, YP0028, YP0121, YP0008, YP0039, YP0115, YP0119, YP0120, and YP0374.

v. Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: Arabidopsis viviparous-1 (see, GenBank No. U93215); Arabidopsis atmycl (see, Urao, Plant Mol. Biol., 32:571-57 (1996); Conceicao, Plant, 5:493-505 (1994)); Arabidopsis FIE (GenBank No. AF129516); Arabidopsis MEA; Arabidopsis FIS2 (GenBank No. AF096096); and FIE 1.1 (U.S. Pat. No. 6,906,244). Other promoters that may be suitable include those derived from the following genes: maize MAC1 (see, Sheridan, Genetics, 142:1009-1020 (1996)); maize Cat3 (see, GenBank No. L05934; Abler, Plant Mol. Biol., 22:10131-1038 (1993)). Other promoters include the following Arabidopsis promoters: YP0039, YP0101, YP0102, YP0110, YP0117, YP0119, YP0137, DME, YP0285, and YP0212. Other promoters that may be useful include the following rice promoters: p530c10, pOsFIE2-2, pOsMEA, pOsYp102, and pOsYp285.

vi. Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (Plant Cell Rep 20:647-654 (2001)), YP0097, YP0107, YP0088, YP0143, YP0156, PT0650, PT0695, PT0723, PT0838, PT0879, and PT0740.

vii. Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (Larix laricina), the pine cab6 promoter (Yamamoto et al., Plant Cell Physiol., 35:773-778 (1994)), the Cab-1 promoter from wheat (Fejes et al., Plant Mol. Biol., 15:921-932 (1990)), the CAB-1 promoter from spinach (Lubberstedt et al., Plant Physiol., 104:997-1006 (1994)), the cab1R promoter from rice (Luan et al., Plant Cell, 4:971-981 (1992)), the pyruvate orthophosphate dikinase (PPDK) promoter from corn (Matsuoka et al., Proc. Natl. Acad. Sci. USA, 90:9586-9590 (1993)), the tobacco Lhcb1*2 promoter (Cerdan et al., Plant Mol. Biol., 33:245-255 (1997)), the Arabidopsis thaliana SUC2 sucrose-H+ symporter promoter (Truernit et al., Planta, 196:564-570 (1995)), and thylakoid membrane protein promoters from spinach (psaD, psaF, psaE, PC, FNR, atpC, atpD, cab, rbcS). Other photosynthetic tissue promoters include PT0535, PT0668, PT0886, YP0144, YP0380 and PT0585.

viii. Vascular Tissue Promoters

Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner, Plant Cell, 3(10):1051-1061 (1991)), the Commelina yellow mottle virus (CoYMV) promoter (Medberry et al., Plant Cell, 4(2):185-192 (1992)), and the rice tungro bacilliform virus (RTBV) promoter (Dai et al., Proc. Natl. Acad. Sci. USA, 101(2):687-692 (2004)).

ix. Inducible Promoters

Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380, PT0848, YP0381, YP0337, PT0633, YP0374, PT0710, YP0356, YP0385, YP0396, YP0388, YP0384, PT0688, YP0286, YP0377, PD1367, and PD0901. Examples of nitrogen-inducible promoters include PT0863, PT0829, PT0665, and PT0886. Examples of shade-inducible promoters include PRO924 and PT0678. An example of a promoter induced by salt is rd29A (Kasuga et al. (1999) Nature Biotech 17: 287-291).

x. Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

xi. Stem Promoters

A stem promoter may be specific to one or more stem tissues or specific to stem and other plant parts. Stem promoters may have high or preferential activity in, for example, epidermis and cortex, vascular cambium, procambium, or xylem. Examples of stem promoters include YP0018 which is disclosed in US20060015970 and CryIA (b) and CryIA(c) (Braga et al. 2003, Journal of New Seeds 5:209-221).

xii. Other Promoters

Other classes of promoters include, but are not limited to, shoot-preferential, callus-preferential, trichome cell-preferential, guard cell-preferential such as PT0678, tuber-preferential, parenchyma cell-preferential, and senescence-preferential promoters. Promoters designated YP0086, YP0188, YP0263, PT0758, PT0743, PT0829, YP0119, and YP0096, as described in the above-referenced patent applications, may also be useful.

xiii. Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, for example, more than one regulatory region can be operably linked to the sequence of a polynucleotide encoding an aluminum tolerance-modulating polypeptide.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

IV. Transgenic Plants and Plant Cells

A. Transformation

The invention also features transgenic plant cells and plants comprising at least one recombinant nucleic acid construct described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Transgenic plant cells used in methods described herein can constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species, or for further selection of other desirable traits. Alternatively, transgenic plants can be propagated vegetatively for those species amenable to such techniques. As used herein, a transgenic plant also refers to progeny of an initial transgenic plant provided the progeny inherits the transgene. Seeds produced by a transgenic plant can be grown and then selfed (or outcrossed and selfed) to obtain seeds homozygous for the nucleic acid construct.

Transgenic plants can be grown in suspension culture, or tissue or organ culture. For the purposes of this invention, solid and/or liquid tissue culture techniques can be used. When using solid medium, transgenic plant cells can be placed directly onto the medium or can be placed onto a filter that is then placed in contact with the medium. When using liquid medium, transgenic plant cells can be placed onto a flotation device, e.g., a porous membrane that contacts the liquid medium. A solid medium can be, for example, Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous aluminum tolerance-modulating polypeptide whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880; 5,204,253; 6,329,571 and 6,013,863. If a cell or cultured tissue is used as the recipient tissue for transformation, plants can be regenerated from transformed cultures if desired, by techniques known to those skilled in the art.

B. Screening/Selection

A population of transgenic plants can be screened and/or selected for those members of the population that have a trait or phenotype conferred by expression of the transgene. For example, a population of progeny of a single transformation event can be screened for those plants having a desired level of expression of an aluminum tolerance-modulating polypeptide or nucleic acid. In some embodiments, a population of plants can be selected that has increased tolerance to elevated levels of $Al^{3+}$ in soil without increased tolerance to drought or elevated saline levels. Plant species vary in their capacity to tolerate salinity. "Salinity" refers to a set of environmental conditions under which a plant will begin to suffer the effects of elevated salt concentration, such as ion imbalance, decreased stomatal conductance, decreased photosynthesis, decreased growth rate, increased cell death, loss of turgor (wilting), or ovule abortion. For these reasons, plants experiencing salinity stress typically exhibit a significant reduction in biomass and/or yield.

Physical and biochemical methods can be used to identify expression levels. These include Southern analysis or PCR amplification for detection of a polynucleotide; Northern blots, S1 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known. As an alternative, a population of plants comprising independent transformation events can be screened for those plants having a desired trait, such as increased tolerance to elevated levels of aluminum. Selection and/or screening can be carried out over one or more generations, and/or in more than one geographic location. In some cases, transgenic plants can be grown and selected under conditions which induce a desired phenotype or are otherwise necessary to produce a desired phenotype in a transgenic plant. In addition, selection and/or screening can be applied during a particular developmental stage in which the phenotype is expected to be exhibited by the plant. Selection and/or screening can be carried out to choose those transgenic plants having a statistically significant difference in an aluminum tolerance level relative to a control plant that lacks the transgene. Selected or screened transgenic plants have an altered phenotype as compared to a corresponding control plant, as described in the "Transgenic Plant Phenotypes" section herein.

C. Plant Species

The polynucleotides and vectors described herein can be used to transform a number of monocotyledonous and dicotyledonous plants and plant cell systems, including species from one of the following families: Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, or Vitaceae.

Suitable species may include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis,* and *Zea.*

Suitable species include *Panicum* spp., *Sorghum* spp., *Miscanthus* spp., *Saccharum* spp., *Erianthus* spp., *Populus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cordgrass), *Medicago sativa* (alfalfa), *Arundo donax* (giant reed), *Secale cereale* (rye), *Salix* spp. (willow), *Eucalyptus* spp. (eucalyptus), Triticosecale (triticum—wheat X rye) and bamboo.

Suitable species also include *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea.*

Suitable species also include *Beta vulgaris* (sugarbeet), and *Manihot esculenta* (cassava)

Suitable species also include *Lycopersicon esculentum* (tomato), *Lactuca sativa* (lettuce), *Musa paradisiaca* (banana), *Solanum tuberosum* (potato), *Brassica oleracea* (broccoli, cauliflower, Brussels sprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum* annum (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), and *Solanum melongena* (eggplant).

Suitable species also include *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica, Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum (Huperzia serrata), Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii,* and *Tanacetum parthenium.*

Suitable species also include *Parthenium argentatum* (guayule), *Hevea* spp. (rubber), *Mentha spicata* (mint), *Mentha piperita* (mint), *Bixa orellana,* and *Alstroemeria* spp.

Suitable species also include *Rosa* spp. (rose), *Dianthus caryophyllus* (carnation), *Petunia* spp. (petunia) and *Poinsettia pulcherrima* (poinsettia).

Suitable species also include *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple), *Hordeum vulgare* (barley), *Poa pratensis* (bluegrass), *Lolium* spp. (ryegrass) and *Phleum pratense* (timothy).

In some embodiments, a suitable species can be a wild, weedy, or cultivated *Pennisetum* species such as, but not limited to, *Pennisetum alopecuroides, Pennisetum arnhemicum, Pennisetum caffrum, Pennisetum clandestinum, Pennisetum divisum, Pennisetum glaucum, Pennisetum latifolium, Pennisetum macrostachyum, Pennisetum macrourum, Pennisetum orientate, Pennisetum pedicellatum, Pennisetum polystachion, Pennisetum polystachion* ssp. *Setosum, Pennisetum purpureum, Pennisetum setaceum, Pennisetum*

*subangustum, Pennisetum typhoides, Pennisetum villosum,* or hybrids thereof (e.g., *Pennisetum purpureum* x *Pennisetum typhoidum*).

In some embodiments, a suitable species can be a wild, weedy, or cultivated *Miscanthus* species and/or variety such as, but not limited to, *Miscanthus* x *giganteus, Miscanthus sinensis, Miscanthus* x *ogiformis, Miscanthus floridulus, Miscanthus transmorrisonensis, Miscanthus oligostachyus, Miscanthus nepalensis, Miscanthus sacchariflorus, Miscanthus* x *giganteus* 'Amuri', *Miscanthus* x *giganteus* 'Nagara', *Miscanthus* x *giganteus* 'Illinois', *Miscanthus sinensis* var. 'Goliath', *Miscanthus sinensis* var. 'Roland', *Miscanthus sinensis* var. 'Africa', *Miscanthus sinensis* var. 'Fern Osten', *Miscanthus sinensis* var. *gracillimus, Miscanthus sinensis* var. *variegates, Miscanthus sinensis* var. *purpurascens, Miscanthus sinensis* var. 'Malepartus', *Miscanthus sacchariflorus* var. 'Robusta', *Miscanthus sinensis* var. 'Silberfedher' (aka. Silver Feather), *Miscanthus transmorrisonensis, Miscanthus condensatus, Miscanthus yakushimanum, Miscanthus* var. 'Alexander', *Miscanthus* var. 'Adagio', *Miscanthus* var. 'Autumn Light', *Miscanthus* var. 'Cabaret', *Miscanthus* var. 'Condensatus', *Miscanthus* var. 'Cosmopolitan', *Miscanthus* var. 'Dixieland', *Miscanthus* var. 'Gilded Tower' (U.S. Pat. No. PP14,743), *Miscanthus* var. 'Gold Bar' (U.S. Pat. No. PP15,193), *Miscanthus* var. 'Gracillimus', *Miscanthus* var. 'Graziella', *Miscanthus* var. 'Grosse Fontaine', *Miscanthus* var. 'Hinjo aka Little Nicky'™, *Miscanthus* var. 'Juli', *Miscanthus* var. 'Kaskade', *Miscanthus* var. 'Kirk Alexander', *Miscanthus* var. 'Kleine Fontaine', *Miscanthus* var. 'Kleine Silberspinne' (aka. 'Little Silver Spider'), *Miscanthus* var. 'Little Kitten', *Miscanthus* var. 'Little Zebra' (U.S. Pat. No. PP13,008), *Miscanthus* var. 'Lottum', *Miscanthus* var. 'Malepartus', *Miscanthus* var. 'Morning Light', *Miscanthus* var. 'Mysterious Maiden' (U.S. Pat. No. PP16, 176), *Miscanthus* var. 'Nippon', *Miscanthus* var. 'November Sunset', *Miscanthus* var. 'Parachute', *Miscanthus* var. 'Positano', *Miscanthus* var. 'Puenktchen'(aka 'Little Dot'), *Miscanthus* var. 'Rigoletto', *Miscanthus* var. 'Sarabande', *Miscanthus* var. 'Silberpfeil' (aka. Silver Arrow), *Miscanthus* var. 'Silverstripe', *Miscanthus* var. 'Super Stripe' (U.S. Pat. No. PP18,161), *Miscanthus* var. 'Strictus', or *Miscanthus* var. 'Zebrinus'.

In some embodiments, a suitable species can be a wild, weedy, or cultivated *sorghum* species and/or variety such as, but not limited to, *Sorghum almum, Sorghum amplum, Sorghum angustum, Sorghum arundinaceum, Sorghum bicolor* (such as bicolor, guinea, caudatum, kafir, and durra), *Sorghum brachypodum, Sorghum bulbosum, Sorghum burmahicum, Sorghum controversum, Sorghum drummondii, Sorghum ecarinatum, Sorghum exstans, Sorghum grande, Sorghum halepense, Sorghum interjectum, Sorghum intrans, Sorghum laxiflorum, Sorghum leiocladum, Sorghum macrospermum, Sorghum matarankense, Sorghum miliaceum, Sorghum nigrum, Sorghum nitidum, Sorghum plumosum, Sorghum propinquum, Sorghum purpureosericeum, Sorghum stipoideum, Sorghum sudanensese, Sorghum timorense, Sorghum trichocladum, Sorghum versicolor, Sorghum virgatum, Sorghum vulgare,* or hybrids such as *Sorghum* x *almum, Sorghum* x *sudangrass* or *Sorghum* x *drummondii*.

Thus, the methods and compositions can be used over a broad range of plant species, including species from the dicot genera *Brassica, Carthamus, Glycine, Gossypium, Helianthus, Jatropha, Parthenium, Populus,* and *Ricinus*; and the monocot genera *Elaeis, Festuca, Hordeum, Lolium, Oryza, Panicum, Pennisetum, Phleum, Poa, Saccharum, Secale, Sorghum, Triticosecale, Triticum,* and *Zea*. In some embodiments, a plant is a member of the species *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), or *Pennisetum glaucum* (pearl millet).

In certain embodiments, the polynucleotides and vectors described herein can be used to transform a number of monocotyledonous and dicotyledonous plants and plant cell systems, wherein such plants are hybrids of different species or varieties of a specific species (e.g., *Saccharum* sp. X *Miscanthus* sp., *Sorghum* sp. X *Miscanthus* sp., e.g., *Panicum virgatum* x *Panicum amarum, Panicum virgatum* x *Panicum amarulum,* and *Pennisetum purpureum* x *Pennisetum typhoidum*).

D. Transgenic Plant Phenotypes

In some embodiments, a plant expressing an aluminum tolerance-modulating polypeptide can have increased levels of aluminum tolerance in plants. The aluminum tolerance level can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the aluminum tolerance level in a corresponding control plant that does not express the transgene. As described above, aluminum tolerance can be assessed by monitoring root growth or plant height in acidic soils containing elevated levels of $Al^{3+}$.

A plant in which expression of an aluminum tolerance-modulating polypeptide is modulated can have increased or decreased levels of seed production. The level can be increased or decreased by at least 2 percent, e.g., 2, 3, 4, 5, 10, 15, 20, 25, 30, 35, or more than 35 percent, as compared to the seed production level in a corresponding control plant that does not express the transgene. Increases in seed production can provide improved nutritional availability in geographic locales where intake of plant foods is often insufficient, or for biofuel production.

Typically, a difference in the amount of aluminum tolerance (e.g., as measured by root growth or plant height) in a transgenic plant relative to a control plant is considered statistically significant at $p \le 0.05$ with an appropriate parametric or non-parametric statistic, e.g., Chi-square test, Student's t-test, Mann-Whitney test, or F-test. In some embodiments, a difference in the amount of aluminum tolerance is statistically significant at $p<0.01$, $p<0.005$, or $p<0.001$. A statistically significant difference in, for example, the amount of aluminum tolerance in a transgenic plant compared to the amount of a control plant indicates that the recombinant nucleic acid present in the transgenic plant results in altered aluminum tolerance levels.

The phenotype of a transgenic plant is evaluated relative to a control plant. A plant is said "not to express" a polypeptide when the plant exhibits less than 10%, e.g., less than 9%, 8%, 7%, 6%, 5%, 4%, 3%, 2%, 1%, 0.5%, 0.1%, 0.01%, or 0.001%, of the amount of polypeptide or mRNA encoding the polypeptide exhibited by the plant of interest. Expression can be evaluated using methods including, for example, RT-PCR, Northern blots, 51 RNase protection, primer extensions, Western blots, protein gel electrophoresis, immunoprecipitation, enzyme-linked immunoassays, chip assays, and mass spectrometry. It should be noted that if a polypeptide is expressed under the control of a tissue-preferential or broadly expressing promoter, expression can be evaluated in the entire plant or in a selected tissue. Similarly, if a polypeptide is expressed at a particular time, e.g., at a particular time in development or upon induction, expression can be evaluated selectively at a desired time period.

V. Modifying Endogenous Nucleic Acids Encoding Aluminum Tolerance-Modulating Polypeptides This document also features plant cells and plants in which an endogenous aluminum tolerance-modulating nucleic acid described herein has been modified (e.g., a regulatory region, intron, or coding region of the aluminum tolerance-modulating nucleic acid has been modified). The aluminum tolerance of such plants is altered relative to the corresponding level of a control plant in which the endogenous nucleic acid is not modified. Such plants are referred to herein as modified plants and may be used to produce, for example, increased amounts of aluminum tolerance.

Endogenous nucleic acid can be modified by homologous recombination techniques. For example, sequence specific endonucleases (e.g., zinc finger nucleases (ZFNs)) and meganucleases can be used to stimulate homologous recombination at endogenous plant genes. See, e.g., Townsend et al., *Nature* 459:442-445 (2009); Tovkach et al., *Plant J.*, 57:747-757 (2009); and Lloyd et al., *Proc. Natl. Acad. Sci. USA*, 102:2232-2237 (2005). In particular, ZFNs engineered to create DNA double strand breaks at specific loci can be used to make targeted sequence changes in endogenous plant genes. For example, an endogenous plant gene can be replaced with a variant containing one or more mutations (e.g., produced using site-directed mutagenesis or directed evolution). In some embodiments, site directed mutagenesis is achieved via non-homologous end joining such that after breaking DNA, endogenous DNA repair mechanisms ligate the break, often introducing slight deletions or additions that can be screened at the cell or plant level for desired phenotypes. Moore and Haber, *Mol Cell Biol.*, 16(5):2164-73 (1996).

In some embodiments, endogenous nucleic acids can be modified by methylation or demethylation such that the expression of the modified endogenous nucleic acid is altered. For example, a double stranded RNA can be used to activate gene expression by targeting noncoding regulatory regions in gene promoters. See Shibuya et al., *Proc Natl Acad Sci USA*, 106(5): 1660-1665 (2009); and Li et al., *Proc Natl Acad Sci USA*, 103(46):17337-42 (2006). In some embodiments, ZFNs engineered to create DNA double strand breaks at specific loci can be used to insert a DNA fragment having at least one region that overlaps with the endogenous DNA to facilitate homologous recombination, such that the non-overlapping portion of the DNA fragment is integrated at the break site. For example, a fragment can be inserted into an endogenous promoter and/or regulatory region at a specific site where a ZFN creates a double stranded break to alter the expression of an endogenous gene. For example, a fragment that is inserted into an endogenous gene coding region at a specific site where a ZFN creates a double stranded break can result in expression of a chimeric gene. For example, a fragment that functions as a regulator region or promoter that is inserted into an endogenous DNA region immediately upstream of a gene coding sequence at a specific site where a ZFN creates a double stranded break can result in altered expression of the endogenous gene.

In some embodiments, endogenous nucleic acids can be modified using activation tagging. For example, a vector containing multiple copies of an enhancer element from the constitutively active promoter of the cauliflower mosaic virus (CaMV) $^{35}$S gene can be used to activate an endogenous gene. See, Weigel et al., *Plant Physiology,* 122:1003-1013 (2000).

In some embodiments, endogenous nucleic acids can be modified by introducing an engineered transcription activation/repression factor (e.g., zinc finger protein transcription factor, or ZFP TF. See, for example, the world wide web at sangamo.com/tech/techplat_over.html#whatarezfp). For example, a synthetic transcription facto sequence of a zinc finger DNA binding domain and a VP16 activation domain can be designed to bind to a specific endogenous DNA site and alter expression of an endogenous gene. An engineered transcription activation/repression factor (such as ZFP TF) can activate, repress, or switch the target endogenous aluminum tolerance gene expression by binding specifically to the promoter region or coding region of the endogenous gene. Engineered nucleases that cleave specific DNA sequences in vivo can also be valuable reagents for targeted mutagenesis. One such class of sequence-specific nucleases can be created by fusing transcription activator-like effectors (TALEs) to the catalytic domain of the FokI endonuclease. Both native and custom TALE-nuclease fusions direct DNA double-strand breaks to specific, targeted sites. Christian et al., *Genetics* 186: 757-761 (2010).

In some embodiments, endogenous nucleic acids can be modified by mutagenesis. Genetic mutations can be introduced within regenerable plant tissue using one or more mutagenic agents. Suitable mutagenic agents include, for example, ethyl methane sulfonate (EMS), N-nitroso-N-ethylurea (ENU), methyl N-nitrosoguanidine (MNNG), ethidium bromide, diepoxybutane, ionizing radiation, x-rays, UV rays and other mutagens known in the art. Suitable types of mutations include, for example, insertions or deletions of nucleotides, and transitions or transversions in the endogenous nucleic acid sequence. In one embodiment, TILLING (Targeted Induced Local Lesions In Genomes) can be used to produce plants having a modified endogenous nucleic acid. TILLING combines high-density mutagenesis with high-throughput screening methods. See, for example, McCallum et al., Nat Biotechnol 18: 455-457 (2000); reviewed by Stemple, Nat Rev Genet. 5(2):145-50 (2004).

In some embodiments, an endogenous nucleic acid can be modified via a gene silencing technique. See, for example, the section herein regarding "Inhibition of Expression of an aluminum tolerance-Modulating Polypeptide."

A population of plants can be screened and/or selected for those members of the population that have a modified nucleic acid. A population of plants also can be screened and/or selected for those members of the population that have a trait or phenotype conferred by expression of the modified nucleic acid. As an alternative, a population of plants can be screened for those plants having a desired trait, such as a modulated level of aluminum tolerance. For example, a population of progeny can be screened for those plants having a desired level of expression of an aluminum tolerance-modulating polypeptide or nucleic acid. Physical and biochemical methods can be used to identify modified nucleic acids and/or expression levels as described with transgenic plants. Selection and/or screening can be carried out over one or more generations, and/or in more than one geographic location. In some cases, plants can be grown and selected under conditions which induce a desired phenotype or are otherwise necessary to produce a desired phenotype in a modified plant. In addition, selection and/or screening can be applied during a particular developmental stage in which the phenotype is expected to be exhibited by the plant.

Selection and/or screening can be carried out to choose those modified plants having a statistically significant difference in an aluminum tolerance level relative to a control plant in which the nucleic acid has not been modified. Selected or screened modified plants have an altered phenotype as compared to a corresponding control plant, as described in the "Transgenic Plant Phenotypes" section herein.

Although a plant or plant cell in which an endogenous aluminum tolerance-modulating nucleic acid has been modified is not transgenic for that particular nucleic acid, it will be appreciated that such a plant or cell may contain transgenes. For example, a modified plant can contain a transgene for other traits, such as herbicide tolerance or insect resistance. As another example, a modified plant can contain one or more transgenes that, in conjuction with modifications of one or more endogenous nucleic acids, exhibits an increase in aluminum tolerance.

As with transgenic plant cells, modified plant cells can constitute part or all of a whole plant. Such plants can be grown in the same manner as described for transgenic plants and can be bred or propagated in the same manner as described for transgenic plants.

VI. Plant Breeding

Genetic polymorphisms that are useful in such methods include simple sequence repeats (SSRs, or microsatellites), rapid amplification of polymorphic DNA (RAPDs), single nucleotide polymorphisms (SNPs), amplified fragment length polymorphisms (AFLPs) and restriction fragment length polymorphisms (RFLPs). SSR polymorphisms can be identified, for example, by making sequence specific probes and amplifying template DNA from individuals in the population of interest by PCR. For example, PCR techniques can be used to enzymatically amplify a genetic marker associated with a nucleotide sequence conferring a specific trait (e.g., nucleotide sequences described herein). PCR can be used to amplify specific sequences from DNA as well as RNA, including sequences from total genomic DNA or total cellular RNA. When using RNA as a source of template, reverse transcriptase can be used to synthesize complementary DNA (cDNA) strands. Various PCR methods are described, for example, in *PCR Primer: A Laboratory Manual*, Dieffenbach and Dveksler, eds., Cold Spring Harbor Laboratory Press, 1995.

Generally, sequence information from polynucleotides flanking the region of interest or beyond is employed to design oligonucleotide primers that are identical or similar in sequence to opposite strands of the template to be amplified. Primers are typically 14 to 40 nucleotides in length, but can range from 10 nucleotides to hundreds of nucleotides in length. Template and amplified DNA is repeatedly denatured at a high temperature to separate the double strand, then cooled to allow annealing of primers and the extension of nucleotide sequences through the microsatellite, resulting in sufficient DNA for detection of PCR products. If the probes flank an SSR in the population, PCR products of different sizes will be produced. See, e.g., U.S. Pat. No. 5,766,847.

PCR products can be qualitative or quantitatively analyzed using several techniques. For example, PCR products can be stained with a fluorescent molecule (e.g., PicoGreen® or OliGreen®) and detected in solution using spectrophotometry or capillary electrophoresis. In some cases, PCR products can be separated in a gel matrix (e.g., agarose or polyacrylamide) by electrophoresis, and size-fractionated bands comprising PCR products can be visualized using nucleic acid stains. Suitable stains can fluoresce under UV light (e.g., Ethidium bromide, GR Safe, SYBR® Green, or SYBR® Gold). The results can be visualized via transillumination or epi-illumination, and an image of the fluorescent pattern can be acquired using a camera or scanner, for example. The image can be processed and analyzed using specialized software (e.g., ImageJ) to measure and compare the intensity of a band of interest against a standard loaded on the same gel.

Alternatively, SSR polymorphisms can be identified by using PCR product(s) as a probe against Southern blots from different individuals in the population. See, U. H. Refseth et al., (1997) *Electrophoresis* 18: 1519. Briefly, PCR products are separated by length through gel electrophoresis and transferred to a membrane. SSR-specific DNA probes, such as oligonucleotides labeled with radioactive, fluorescent, or chromogenic molecules, are applied to the membrane and hybridize to bound PCR products with a complementary nucleotide sequence. The pattern of hybridization can be visualized by autoradiography or by development of color on the membrane, for example.

In some cases, PCR products can be quantified using a real-time thermocycler detection system. For example, Quantitative real-time PCR can use a fluorescent dye that forms a DNA-dye-complex (e.g., SYBR® Green), or a fluorophore-containing DNA probe, such as single-stranded oligonucleotides covalently bound to a fluorescent reporter or fluorophore (e.g. 6-carboxyfluorescein or tetrachlorofluorescin) and quencher (e.g., tetramethylrhodamine or dihydrocyclopyrroloindole tripeptide minor groove binder). The fluorescent signal allows detection of the amplified product in real time, thereby indicating the presence of a sequence of interest, and allowing quantification of the copy number of a sequence of interest in cellular DNA or expression level of a sequence of interest from cellular mRNA.

The identification of RFLPs is discussed, for example, in Alonso-Blanco et al. (*Methods in Molecular Biology*, vol. 82, "*Arabidopsis* Protocols", pp. 137-146, J. M. Martinez-Zapater and J. Salinas, eds., c. 1998 by Humana Press, Totowa, N.J.); Burr ("Mapping Genes with Recombinant Inbreds", pp. 249-254, in Freeling, M. and V. Walbot (Ed.), *The Maize Handbook*, c. 1994 by Springer-Verlag New York, Inc.: New York, N.Y., USA; Berlin Germany; Burr et al. *Genetics* (1998) 118: 519; and Gardiner, J. et al., (1993) *Genetics* 134: 917). For example, to produce a RFLP library enriched with single- or low-copy expressed sequences, total DNA can be digested with a methylation-sensitive enzyme (e.g., PstI). The digested DNA can be separated by size on a preparative gel. Polynucleotide fragments (500 to 2000 bp) can be excised, eluted and cloned into a plasmid vector (e.g., pUC18). Southern blots of plasmid digests can be probed with total sheared DNA to select clones that hybridize to single- and low-copy sequences. Additional restriction endonucleases can be tested to increase the number of polymorphisms detected.

The identification of AFLPs is discussed, for example, in EP 0 534 858 and U.S. Pat. No. 5,878,215. In general, total cellular DNA is digested with one or more restriction enzymes. Restriction halfsite-specific adapters are ligated to all restriction fragments and the fragments are selectively amplified with two PCR primers that have corresponding adaptor and restriction site specific sequences. The PCR products can be visualized after size-fractionation, as described above.

In some embodiments, the methods are directed to breeding a plant line. Such methods use genetic polymorphisms identified as described above in a marker assisted breeding program to facilitate the development of lines that have a desired alteration in the aluminum tolerance trait. Once a suitable genetic polymorphism is identified as being associated with variation for the trait, one or more individual plants are identified that possess the polymorphic allele correlated with the desired variation. Those plants are then used in a breeding program to combine the polymorphic allele with a plurality of other alleles at other loci that are correlated with the desired variation. Techniques suitable for use in a plant breeding program are known in the art and include, without limitation, backcrossing, mass selection, pedigree breeding, bulk selection, crossing to another population and recurrent selection. These techniques can be used alone or in combination with one or more other techniques in a breeding program. Thus, each identified plants is selfed or crossed a different plant to produce seed which is then germinated to form progeny plants. At least one such progeny plant is then selfed or crossed with a different plant to form a subsequent progeny generation. The breeding program can repeat the steps of selfing or outcrossing for an additional 0 to 5 generations as appropriate in order to achieve the desired uniformity and stability in the resulting plant line, which retains the polymorphic allele. In most breeding programs, analysis for the particular polymorphic allele will be carried out in each generation, although analysis can be carried out in alternate generations if desired.

In some cases, selection for other useful traits is also carried out, e.g., selection for fungal resistance or bacterial resistance. Selection for such other traits can be carried out before, during or after identification of individual plants that possess the desired polymorphic allele.

VII. Articles of Manufacture

Transgenic plants provided herein have various uses in the agricultural and energy production industries. For example, transgenic plants described herein can be used to make animal feed and food products. Such plants, however, are often particularly useful as a feedstock for energy production.

Transgenic plants described herein produce higher yields of grain and/or biomass per hectare, relative to control plants that lack the exogenous nucleic acid or lack the modified endogenous nucleic acid when grown on soils with a pH less than 5 and elevated aluminum levels. For example, transgenic plants described herein can have a grain yield that is increased about 5% to about 20% (e.g., increased 5% to 10%, 5% to 15%, 10% to 15%, 10% to 20%, or 15% to 20%) relative to that of control plants lacking the exogenous nucleic acid or lacking the modified endogenous nucleic acid. In some embodiments, such transgenic plants provide equivalent or even increased yields of grain and/or biomass per hectare relative to control plants when grown under conditions of reduced inputs such as fertilizer and/or water. Thus, such transgenic plants can be used to provide yield stability at a lower input cost and/or under environmentally stressful conditions such as low pH and elevated aluminum levels.

In some embodiments, plants described herein have a composition that permits more efficient processing into free sugars, and subsequently ethanol, for energy production. In some embodiments, such plants provide higher yields of ethanol, butanol, dimethyl ether, other biofuel molecules, and/or sugar-derived co-products per kilogram of plant material, relative to control plants. Such processing efficiencies are believed to be derived from the composition of the plant material, including, but not limited to, content of glucan, cellulose, hemicellulose, and lignin. By providing higher yields at an equivalent or even decreased cost of production, the transgenic plants described herein improve profitability for farmers and processors as well as decrease costs to consumers.

Seeds from transgenic plants described herein can be conditioned and bagged in packaging material by means known in the art to form an article of manufacture. Packaging material such as paper and cloth are well known in the art. A package of seed can have a label, e.g., a tag or label secured to the packaging material, a label printed on the packaging material, or a label inserted within the package, that describes the nature of the seeds therein.

The invention will be further described in the following examples, which do not limit the scope of the invention described in the claims.

VIII. Examples

Example 1

Materials and Methods

Plant agar culture media lacking phosphate were prepared in 2 L Pyrex glass bottles and contained the following per 1 L: 0.78 g/L of ½×MS without $KH_2PO_4$ (Sigma Chemical Co., St. Louis, Mo.), 0.5 g/L MES (Sigma Chemical Co.) and 7 g/L of 0.7% Phytagar (EM Science, Gibbstown, N.J.). Media were stirred for 30 minutes after the addition of ½ MS. The pH after the MS was completely dissolved was close to pH 5.7, and adjusted using KOH. The final pH of each batch was measured due to pH variability between batches. Media preparations were autoclaved at about 121° C. for 25 minutes on a liquid setting. Approximately 40 mL of media were added to each square plate (100×100×15 mm) in a laminar flow hood using a liquid dispensing device or 50 mL sterile pipette. The plates were immediately covered with lids to avoid contamination. Plates were allowed to cool in a laminar flow hood for at least 1 hour, but not more than 3 hours, with a blower on. Plates were stored in 4° C. in bags.

Liquid media lacking phosphate for use in Al assays were prepared in 2 L Pyrex glass bottles and contained per 1 L: 0.78 g/L of MS salt without $KH_2PO_4$ (Sigma Chemical Co.), 0.5 g/L MES (Sigma Chemical Co.), and 6 mL of 0.1M $AlCl_3$ (Sigma Chemical Co.) (600 µM $AlCl_3$ and predicted $Al^{+3}$ activity of 160 µM). Media were stirred for 30 minutes while the pH was adjusted slowly to pH 4.0 using 1N HCL. $AlCl_3$ was added after autoclaving. The preparations were autoclaved at about 121° C. for 25 minutes on a liquid setting.

Agar buffer media lacking phosphate, for use in Al assays, were prepared in 2 L Pyrex glass bottles and contained per 1 L: 0.78 g/L of MS salt without $KH_2PO_4$ (Sigma Chemical Co.), 0.5 g/L MES (Sigma Chemical Co.), and 4 g/L Phytagar (EM Science), with 1N HCL used to adjust to a pH of 4.8. The media were stirred for 30 minutes after the addition Phytagar and 1 N HCL. The final pH of each batch was recorded due to pH variability between batches. The media preparations were autoclaved at about 121° C. for 25 minutes on liquid setting. Approximately 20 mL of warm agar containing $Al^{+3}$ media were aliquoted to each of 10 horizontal wells within each hydroponic box (10 horizontal wells per box/10 seeds per horizontal well) using a 50 mL sterile pipette and allowed to solidify for about 2 hours before layering 10 mL of cooled liquid Al media on top over the agar media described above. A thin layer of the liquid media floated on and was suspended over the agar solidified media lacking phosphate and containing $Al^{+3}$. The hydroponic boxes were immediately covered with lids to avoid contamination and evaporation of the liquid layer before $Al^{+3}$ infiltrations into the solid agar layer. The hydroponic boxes were allowed to rest in the laminar flow hood for at least 1 hour, but not more than 3 hours, with a blower on (to avoid evaporation of the liquid layer during infiltration). The hydroponic boxes were stored in 4° C.

To sterilize seeds, the appropriate number of seeds from each candidate plant or ME line event were transferred to individual 2 mL tubes and 1 mL 30% Clorox bleach was added to each tube and agitated manually for at least 5 minutes until all seeds become suspended. Bleach solution then was discarded and seeds were rinsed aseptically with sterile nanopure water at least 4 times or until the seeds were thoroughly rinsed.

Example 2

$Al^{+3}$ Assay for Transgenic Arabidopsis thaliana

Forty-eight $T_3$ generation seeds of each of transgenic ME02064 events-01, -04, -03, plus an empty vector control (SR00559), were sterilized and plated on agar media lacking phosphate hydroponically suspended over $Al^{+3}$ liquid media (see Example 1). In each mini-hydroponic box, 48 control seeds plus 48 ME02064 seeds were sown. Boxes were kept in a 4° C. refrigerator in the dark for 3 days to promote uniform germination. After 3 days of cold treatment, the boxes were placed horizontally in a Conviron growth chamber as described above. The plates were scanned using a fluorescence imager scanner (Technologica Ltd, Colchester, UK) at 7 days and 14 days after sowing seeds. Plants were scored for growth when Al toxicity (e.g., stunted root growth and reduced rosette area) became apparent, usually around 10 days.

The seedling area and fluorescence intensity (Fv/Fm) were quantified in a pooled manner. Fv/Fm measurements as well as rosette area growth for each individual plant were not taken. Rather, the -01, -04, & -03 seedling populations (48 seedlings) were compared to the pooled control (48 seedlings) within the same mini-hydroponic box. Total rosette growth was measured for 48 seedlings from transgenic lines and for 48 seedlings from control lines. Stress that resulted in decreases in the quantum efficiency of photochemistry (open PSII reaction centers), determined by Fv/Fm of dark adapted plants, was considered an indicator of inhibition of photosynthesis by Al Basta resistance was not tested as other assays had indicated that these lines were transgenic.

Rosette area was larger at 10 days in all transgenic events of -01, -04, & -03 when compared to empty vector controls (SR00559) as shown in Table 1. However, no visual difference in root growth was observed (data not shown). Roots for both transgenics and controls were all severely stunted, failing to penetrate from the agar media support into the high $Al^{+3}$ liquid media. The mean Fv/Fm appeared to be moderately higher in transgenic events-01, -04, & -03 relative to controls, but there was no statistically significant difference.

TABLE 1

| 60 µM AlCl₃ 10 days | ME02064-01T3 | SR00559 |
|---|---|---|
| Sum of Rosette Areas (mm²) | 587.74 | 478.23 |
| Mean Fv/Fm | 0.722 | 0.713 |

TABLE 1-continued

| 60 µM AlCl₃ 10 days | ME02064-04T3 | SR00559 |
|---|---|---|
| Sum of Rosette Areas (mm²) | 676.19 | 619.3 |
| Mean Fv/Fm | 0.775 | 0.763 |
| 60 µM AlCl₃ 10 days | ME02064-03T3 | SR00559 |
| Sum of Rosette Areas (mm²) | 578.23 | 436.96 |
| Mean Fv/Fm | 0.712 | 0.717 |

Example 3

$Al^{+3}$ assay for Transgenic Switchgrass Plants

A T-DNA binary vector containing Ceres Clone 375578 (SEQ ID NO:352) was introduced into switchgrass by Agrobacterium-mediated transformation essentially as described in Richards et al., Plant Cell. Rep. 20:48-54 (2001) and Somleva, et al., Crop Sci. 42:2080-2087 (2002). The presence of the transgene was confirmed by PCR. Plants comprising the transgene were grown in acidified soil containing high levels of $Al^{+3}$. The soil was made by dissolving $AlCl_3$ in water and watering the soil with the aluminized water. The soil then was acidified using pH 4 buffered water, to release the toxic aluminum ion. Because the acidity of the soil determines how much of the $Al^{+3}$ is present as the toxic free ion, the Al value was variable. Switchgrass control non-transgenic plants (Wt) and transgenic (CeresClone 375578) plants were placed in soil in separate pots in a growth room and allowed to grow under standard growth room conditions. Non-transgenic plants were generated from calli without co-cultivation with agrobacteria. There was one plant per pot. The plantlets were watered with one of the following three treatments: Treatment 1: 2 L of water, pH 7.26; Treatment 2: 2 L of water, pH 4.0; and Treatment 3: 2 L of water, pH 4.0+~11 g/Kg soil $Al^{+3}$(~621 µM). The size of the transgenics and controls appeared similar when the treatment was started but no measurements were taken. After 16 days, seedlings were harvested, washed, and then dried in a drying oven. The dry weight biomass was measured for each plant.

Transgenic aerial plant growth was greater in the transgenic switchgrass events than in the controls as indicated by an increase in whole plant weight (shoots and roots). The increase was statistically significant at a P value of 0.05 when compared to wild-type plants (see FIG. 5, Tables 2 and 3). Root growth in the transgenic lines was visually more robust than wild-type controls. These results indicate that switchgrass containing Ceres Clone 375578 can survive in acidified soil having an aluminum chloride concentration of about 11 g/kg soil.

TABLE 2

| Whole Plant Weight (Shoots + Roots) | | | | | |
|---|---|---|---|---|---|
| Treatment 1 | | Treatment 2 | | Treatment 3 | |
| Wt | 375578 | Wt | 375578 | Wt | 375578 |
| Mean Weight (g) | 1.23 | 1.4 | 1.33 | 1.39 | 0.73 | 1.44 |
| Standard Error | 0.23 | 0.17 | 0.07 | 0.07 | 0.23 | 0.13 |
| Median | 1 | 1.3 | 1.2 | 1.3 | 0.8 | 1.25 |
| Standard Deviation | 0.40 | 0.55 | 0.12 | 0.23 | 0.40 | 0.42 |

TABLE 2-continued

Whole Plant Weight (Shoots + Roots)

|  | Treatment 1 | | Treatment 2 | | Treatment 3 | |
| --- | --- | --- | --- | --- | --- | --- |
|  | Wt | 375578 | Wt | 375578 | Wt | 375578 |
| Sample Variance | 0.16 | 0.3 | 0.01 | 0.05 | 0.16 | 0.18 |
| Skewness | 1.73 | 0.30 | −1.73 | 0.35 | 0.72 | 1.04 |
| Range | 0.7 | 1.4 | 0.2 | 0.6 | 0.8 | 1.3 |
| Minimum | 1 | 0.8 | 1 | 1.1 | 0.3 | 1 |
| Maximum | 1.7 | 2.2 | 1.2 | 1.7 | 1.1 | 2.3 |
| Sum | 3.7 | 14 | 3.4 | 13.9 | 2.2 | 14.4 |
| Count | 3 | 10 | 3 | 10 | 3 | 10 |

TABLE 3 t-Test: Two-Sample Assuming Unequal Variances of Plants under Treatment 3

|  | Wild type Control, pH 4 | 375578 |
| --- | --- | --- |
| Mean Whole Plant Weight (Shoots + Roots) (g) | 0.73 | 1.44 |
| Variance | 0.16 | 0.18 |
| Observations | 3 | 10 |
| Hypothesized Mean Difference | 0 | |
| Df | 3 | |
| t Stat | −2.63 | |
| P (T <= t) one-tail | 0.04 | |
| t Critical one-tail | 2.35 | |
| P (T <= t) two-tail | 0.08 | |
| t Critical two-tail | 3.18 | |

The results also indicate that wild type plants watered with Treatment 3 (pH 4 but without AlCl$_3$) had a whole plant weight that was less than the whole plant dry weight of wild type plants watered with Treatment 3. The results also indicate that the decrease in whole plant dry weight seen under Treatment 3 conditions was a result of Al$^{+3}$ toxicity, because wild-type plants grown under Treatment 2 conditions (pH 4 but without AlCl$_3$) showed no such decrease in whole plant dry weight (see Table 3).

Example 4

Germination of Rice Seedlings in Media Containing Aluminum

In this example, the role of CeresClone 24255 (Os713, 3 events), CeresClone 1752915 (Os825, 3 events), and CeresClone 11684 (Os879, 3 events) was assessed in rice seeds germinated in the presence of aluminum. Seeds of wild-type internal control (null segregant) and homozygous transgenic plants were placed on two separate plates for each event. Each plate had two rows of 12 seeds aligned in parallel. External wild-type seed were sown at the same time under control (no aluminum chloride) conditions using the same format for comparison of rate of germination and growth to that of Al$^{+3}$ conditions.

Unsterilized, de-husked seeds were germinated under normal or aluminum-stress conditions as follows. Normal conditions included a plate (150 mm×100 mm×15 mm) containing 30 mL of ½ MS medium without phosphate and nitrogen, no sugar, 4 g agar/L pH 5.7. Aluminum-stress conditions included a plate (150 mm×100 mm×15 mm) containing 20 mL of ½ MS medium without phosphate and nitrogen, no sugar, 4 g agar/L pH 5.7, infiltrated with 10 mL AlCl$_3$ liquid infiltration medium containing 600 μM AlCl$_3$ (which corresponds to a predicted ion activity of 160 μM on plates) in ½ MS pH 4. The AlCl$_3$ liquid infiltration medium was added on top of the aluminum medium and allowed to settle for 24 hours before seed placement on the surface. AlCl$_3$ liquid infiltration medium consisted of: ½ MS media without phosphate or nitrogen; no sugar or agar; and 600 μM AlCl$_3$, with the pH adjusted to 4.0 with 1N HCl. Predicted Al$^{+3}$ activities were confirmed with GEOCHEM-EZ, a multi-purpose chemical speciation program. See, Shaff et al., *Plant Soil* 330: 207-214 (2010).

Plates with lids were not sealed but were placed inside large ziplock bags to maintain humidity in growth chamber (25° C., 70% humidity for 8 hours light/16 hours dark). At 13 days, seedlings were measured for plant height and root length. See Tables 4 and 5. For Os713, plant height and root length were not significantly different between the transgenic plants and non-transgenic controls. For Os825 event 9, a significant increase in plant height was observed in comparison to the pooled non-transgenic control. For Os879 event 7, a significant increase in plant height was observed in comparison to the internal non-transgenic control. For Os879 event 4, a significant increase in plant height was observed in comparison to the internal non-transgenic control as well as a significant increase in root length in comparison to the pooled non-transgenic control. For Os870 event 8, a significant increase in root length was observed in comparison to the internal and pooled non-transgenic controls.

TABLE 4

Plant Height after 13 d Aluminum Treatment

| Genotype | Copy number of transgene | #of plants tested | Transgenics | | #r of plants | Non-transgenics | | # of plants | P-value | |
| --- | --- | --- | --- | --- | --- | --- | --- | --- | --- | --- |
|  |  |  | Average | Standard Deviation |  | Average | Standard Deviation |  | Internal NT | Pooled NT |
| OS713-07 | 1 | 24 | 5.11 | 5.01 | 12 | 6.73 | 4.27 | 12 | 0.41 | 0.74 |
| OS713-05 | 1 | 24 | 2.92 | 4.47 | 12 | 1.91 | 2.62 | 12 | 0.50 | 0.22 |
| OS713-03 | 1 | 24 | 6.42 | 5.63 | 12 | 5.21 | 3.43 | 12 | 0.53 | 0.23 |
| All OS713 |  |  | 4.81 | 5.13 | 36 | 4.62 | 3.97 | 36 | 0.86 |  |
| OS825-13 | 1 | 24 | 3.89 | 5.15 | 12 | 2.09 | 2.55 | 12 | 0.28 | 0.61 |
| OS825-10 | 1 | 24 | 3.95 | 4.26 | 12 | 3.15 | 4.43 | 12 | 0.66 | 0.56 |
| OS825-09 | 1 | 24 | 5.95 | 4.95 | 12 | 4.28 | 4.36 | 12 | 0.39 | 0.05 |
| All OS825 |  |  | 4.60 | 4.76 | 36 | 3.17 | 3.88 | 36 | 0.23 |  |
| OS879-08 | 1 | 24 | 5.23 | 4.34 | 12 | 2.88 | 3.96 | 12 | 0.18 | 0.10 |
| OS879-07 | 1 | 24 | 4.88 | 4.50 | 12 | 1.28 | 2.81 | 12 | 0.03 | 0.18 |

TABLE 4-continued

Plant Height after 13 d Aluminum Treatment

| Genotype | Copy number of transgene | # of plants tested | Transgenics | | | Non-transgenics | | | P-value | |
|---|---|---|---|---|---|---|---|---|---|---|
| | | | Average | Standard Deviation | #r of plants | Average | Standard Deviation | # of plants | Internal NT | Pooled NT |
| OS879-04 | 1 | 24 | 5.72 | 4.63 | 12 | 5.03 | 3.73 | 12 | 0.69 | 0.05 |
| All OS879 | | | 5.27 | 4.38 | 36 | 3.07 | 3.77 | 36 | 0.02 | |

TABLE 5

Root Length after 13 d Aluminum Treatment

| Genotype | Number of plants tested | Transgenics | | | Non-transgenics | | | P-value | |
|---|---|---|---|---|---|---|---|---|---|
| | | Average | Standard Deviation | Number of plants | Average | Standard Deviation | Number of plants | Internal NT | Pooled NT |
| OS713-07 | 24 | 0.79 | 0.83 | 12 | 1.5 | 0.87 | 12 | 0.059 | 0.97 |
| OS713-05 | 24 | 0.75 | 1.08 | 12 | 0.2 | 0.36 | 12 | 0.11 | 0.87 |
| OS713-03 | 24 | 1.2 | 1.08 | 12 | 0.7 | 0.50 | 12 | 0.16 | 0.18 |
| | | 0.92 | 1.00 | 36 | 0.8 | 0.81 | 36 | 0.59 | |
| OS825-13 | 24 | 0.38 | 0.64 | 12 | 0.28 | 0.47 | 12 | 0.67 | 0.42 |
| OS825-10 | 24 | 0.38 | 0.87 | 12 | 0.73 | 1.12 | 12 | 0.41 | 0.46 |
| OS825-09 | 24 | 0.58 | 0.51 | 12 | 0.79 | 0.84 | 12 | 0.47 | 0.96 |
| | | 0.45 | 0.68 | 36 | 0.60 | 0.86 | 36 | 0.35 | |
| OS879-08 | 24 | 0.85 | 0.72 | 12 | 0.29 | 0.45 | 12 | 0.03 | 0.005 |
| OS879-07 | 24 | 0.53 | 0.59 | 12 | 0.16 | 0.37 | 12 | 0.08 | 0.23 |
| OS879-04 | 24 | 0.94 | 0.78 | 12 | 0.57 | 0.42 | 12 | 0.16 | 0.002 |
| | | 0.78 | 0.71 | 36 | 0.34 | 0.44 | 36 | 0.002 | |

Example 5

Seedling Growth of Transgenic Rice Containing CeresClone 375578, CeresClone 24255, and CeresClone 11684 in Rice The experiments described in Example 4 were repeated using transgenic rice events for CeresClone 375578 (Line 745282, one of 7 events), CeresClone 24255 (Os713, 3 events), and CeresClone 11684 (Os879, 3 events). After germination under normal or aluminum conditions as described in Example 4, and incubation for 10 or 11 days in the growth chamber, surviving seedlings were transplanted to soil (60% Sunshine Professional Mix (with vermiculite); 40% Turface; 1 tbs/3 L Osmocote; 1.5 tbs/3 L of Bone Meal; and 0.5 tbs/3 L Marathon).

Plants were genotyped as follows. Plants were allowed to recover until the two leaf stage then genotyped by cutting 5 to 6 mm leaf segments from the largest of the two leaves and placed onto Kanamycin medium plates containing 160 mg/L of Kanamycin (¼ MS basal salt medium; 4.5 g/L of Phytoagar; 100 µL/L of Tween 80; and adjusted to pH 5.7 with 1N KOH. Medium was sterilized under the wet cycle for 30 minutes at 120° C. and allowed to cool before adding Kanamcyin to a final concentration of 160 mg/L). Plates were sealed in Ziplock bags and placed in a growth chamber at about 26±2° C. under normal growing light regime (16 h light and 8 h dark).

Plates were removed from the chamber during a light period and scanned starting at 4d of treatment. If unclear, the plates were re-scanned at 5 or 6 days post treatment. Plates were scanned for photosynthetic efficiency (PE) quantification to determine genotype. Generally, PE is a parameter (Fv/Fm, the ratio of variable florescence over the maximum florescence value) used to indicate the quantum efficiency of the photosystem type II (PSII) reactions within the plants chloroplasts. The Fv/Fm parameter is an indication of photosynthetic tissue health. Healthy tissue samples typically achieve an Fv/Fm value of approximately 0.7-0.85. Lower values are observed if a sample is exposed to a biotic or abiotic stress factor that reduce the capacity for photochemical quenching of energy within PSII.

Images of chlorophyll fluorescence and the florescence parameters were obtained with Chlorophyll Fluorescence imager (Technologica, UK) using the manufacturer's instructions for light-adapted materials. Representative regions of the image, e.g., distant from the any cut end to avoid damage effects, were chosen for reading the Fv/Fm values. PCR analysis was used to confirm the presence of transgenes.

After genotyping, plants were grown in soil and treated with either water (Normal) or with acidified water (~pH 4.0) containing 600 µM $AlCl_3$. After 19 days, root length and plant height were measured. Root and plant height data for transgenic plants were statistically compared to non-transgenic (NT) internal segregant lines, pooled NT internal segregant lines, external NT lines, and all NT lines. Comparisons were also made to plants not treated with AL containing water.

Tables 6 and 7 contain the results of line 745282 (7 events) for root expansion at 19 days and plant height at 19 days, respectively. For line 745282, a significant increase in root expansion was observed for events 745282, 745284, 745252, and 745307; a significant increase in plant height was observed for events 745284 and 745236.

Tables 8 and 9 contain the results for Os713 and Os879 for root expansion at 19 days and plant height at 19 days, respectively. For Os879, a significant increase in plant height was observed for event 7.

TABLE 6

Root expansion (cm) under Aluminum treatment 19 d

| | Transgenics | | | Non-transgenics | | | P-value | | | |
|---|---|---|---|---|---|---|---|---|---|---|
| Genotype | Average | Standard Deviation | Number of plants | Average | Standard Deviation | Number of plants | Line Internals NT | Pooled Internals NT | External NT | Internal + External |
| 745282 | 4.55 | 2.9 | 11 | 4.2 | 2.68 | 5 | 0.78 | 0.41 | 0.006 | 0.10 |
| 745284 | 6.38 | 2.05 | 8 | 4.06 | 1.82 | 8 | 0.03 | 0.01 | 3.83E−05 | 0.001 |
| 745236 | 2.23 | 3.14 | 13 | 4.17 | 3.82 | 3 | 0.39 | 0.09 | 0.90 | 0.226 |
| 745252 | 5 | 2.96 | 7 | 3.06 | 3.26 | 9 | 0.24 | 0.30 | 0.011 | 0.083 |
| 745306 | 5.6 | 3.44 | 5 | 6.29 | 2.1 | 11 | 0.62 | 0.18 | 0.008 | 0.050 |
| 745312 | 7.02 | 2.16 | 16 | n/a | n/a | n/a | n/a | 9.93E−05 | 3.58E−08 | 4.25E−07 |
| 745307 | 5.19 | 2.9 | 8 | 4.13 | 2.4 | 8 | 0.44 | 0.20 | 0.005 | 0.043 |
| All transgenics | 5.1 | 3.03 | 68 | 5.1 | 9.06 | | | 0.042 | 0.0001 | 0.001 |
| Pooled NT | | | | 3.833 | 2.59 | 33 | | | | |
| External WT | | | | 2.347 | 2.01 | 23 | | | | |
| Internal + External | | | | 3.22 | 2.46 | 56 | | | | |

TABLE 7

Plant height (cm) under Aluminum treatment 19 d

| | Copy number of transgene | Number of plants tested | Transgenics | | | Non-transgenics | | | P-value | | | |
|---|---|---|---|---|---|---|---|---|---|---|---|---|
| Genotype | | | Average | Standard Deviation | Number of plants | Average | Standard Deviation | Number of plants | Line Internals NT | Pooled Internals NT | External NT | Internal + External NT |
| 745282 | 1 | 16 | 21.45 | 2.9 | 11 | 24.3 | 7.98 | 5 | 0.32 | 0.38 | 0.0002 | 0.293 |
| 745284 | 1 | 16 | 25.63 | 4.24 | 8 | 21.25 | 3.01 | 8 | 0.032 | 0.08 | 3.66E−06 | 0.005 |
| 745236 | 2 | 16 | 23.23 | 2.01 | 13 | 22.67 | 3.06 | 3 | 0.693 | 0.64 | 7.56E−07 | 0.026 |
| 745252 | 1 | 16 | 23.86 | 7.78 | 7 | 21.83 | 3.76 | 9 | 0.502 | 0.56 | 0.0009 | 0.076 |
| 745306 | 1 | 16 | 23.96 | 3.33 | 5 | 25 | 5.56 | 11 | 0.707 | 0.51 | 0.0004 | 0.0958 |
| 745312 | 2 | 16 | 23.98 | 1.92 | 16 | n/a | n/a | n/a | n/a | 0.23 | 1.14E−08 | 0.003 |
| 745307 | 1 | 16 | 21.44 | 2.29 | 8 | 23.94 | 2.88 | 8 | 0.075 | 0.43 | 8.77E−04 | 0.367 |
| All transgenics | 1 & 2 | 112 | 23.31 | 9.42 | 68 | | | | | 0.42 | 8.38E−11 | 0.0003 |
| Pooled NT | 0 | 33 | | | | 22.67 | 9.53 | 33 | | | | |
| External WT | 0 | 23 | | | | 15.2 | 9.54 | 23 | | | | |
| Internal + External | 0 | 56 | | | | 19.59 | 4.99 | 56 | | | | |

TABLE 8

Root Length after 19 d aluminum treatment

| | Transgenics | | | Non-transgenics | | | P-value | | | |
|---|---|---|---|---|---|---|---|---|---|---|
| Genotype | Average | Standard Deviation | Number of plants | Average | Standard Deviation | Number of plants | Internal NT | Pooled NT | External WT | Internal + External |
| W2 (939-006) | 6.1 | 1.55 | 7 | 4.4 | 1.35 | 3 | 0.14 | | 0.49 | 0.22 |
| 713-3 | 5.32 | 0.53 | 6 | 6.13 | 1.31 | 4 | 0.21 | 0.95 | 0.55 | 0.75 |
| 713-5 | 4.63 | 1.60 | 8 | 4 | 0 | 2 | 0.61 | 0.36 | 0.19 | 0.16 |
| 713-7 | 4.19 | 1.93 | 8 | 5 | | 1 | 0.70 | 0.21 | 0.11 | 0.06 |
| 879-4 | 4.33 | 1.22 | 9 | 7 | | 1 | 0.07 | 0.33 | 0.04 | 0.06 |
| 879-7 | 5.56 | 1.81 | 9 | 4 | | 1 | 0.44 | 0.63 | 0.95 | 0.80 |
| 879-8 | 4.29 | 0.70 | 7 | 4.8 | 1.31 | 3 | 0.43 | 0.23 | 0.02 | 0.04 |
| All T713 | 4.65 | 1.54 | 22 | | | | | | | |
| All T879 | 4.76 | 1.44 | 25 | | | | | | | |
| Pooled NT 713_879 | | | | 5.24 | 1.35 | 12 | | | | |
| Pooled NT_713 | | | | 5.36 | 1.38 | 7 | | | | |
| Pooled NT_879 | | | | 5.08 | 1.46 | 5 | | | | |
| External NT WT | | | | 5.6 | 1.02 | 7 | | | | |
| All NT SAP + Externals | | | | 5.37 | 1.22 | 19 | | | | |
| External + NT713 | | | | 5.48 | 1.19 | 14 | | | | |
| External + NT879 | | | | 5.38 | 1.19 | 12 | | | | |
| All T713_Untreated | 7.93 | 2.09 | 7 | | | | | | | |
| All T879_Untreated | 7.7 | 1.86 | 8 | | | | | | | |

TABLE 8-continued

Root Length after 19 d aluminum treatment

| | Transgenics | | | Non-transgenics | | | P-value | | | |
|---|---|---|---|---|---|---|---|---|---|---|
| Genotype | Average | Standard Deviation | Number of plants | Average | Standard Deviation | Number of plants | Internal NT | Pooled NT | External WT | Internal + External |
| All T W2_Untreated | 5.44 | 1.40 | 8 | | | | | | | |
| T713_879_Untreated | 7.09 | 1.46 | 11 | | | | | | | |
| NT713_879_Untreated | | | | 7 | 1.91 | 7 | | | | |

TABLE 9

Plant height after 19 d aluminum treatment

| | Copy number of transgene | Number of plants tested | Transgenics | | | Non-transgenics | | | P-value | | | |
|---|---|---|---|---|---|---|---|---|---|---|---|---|
| Genotype | | | Average | Standard Deviation | Number of plants | Average | Standard Deviation | Number of plants | Internal NT | Pooled NT | External WT | Internal + External |
| W2 (939-006) | 1 | 10 | 16.17 | 0.99 | 7 | 15.33 | 2.04 | 3 | 0.39 | | 0.20 | 0.24 |
| 713-3 | 1 | 10 | 18.3 | 1.01 | 6 | 17.4 | 1.37 | 4 | 0.26 | 0.00 | 0.06 | 0.13 |
| 713-5 | 1 | 10 | 16.76 | 1.60 | 8 | 17.15 | 0.92 | 2 | 0.76 | 0.55 | 0.11 | 0.35 |
| 713-7 | 1 | 10 | 15.06 | 6.78 | 8 | 16.5 | 0.135 | 2 | 0.85 | 0.43 | 0.54 | 0.99 |
| 879-4 | 1 | 10 | 14.78 | 2.89 | 9 | 17.9 | | 1 | 0.34 | 0.07 | 0.45 | 0.93 |
| 879-7 | 1 | 10 | 17.94 | 2.06 | 9 | 16 | | 1 | 0.40 | 0.85 | 0.04 | 0.13 |
| 879-8 | 1 | 10 | 18.09 | 1.71 | 7 | 18.23 | 2.87 | 3 | 0.92 | 0.75 | 0.06 | 0.15 |
| All T713 | 1 | | 16.56 | 4.26 | 22 | | | | | | | |
| All T879 | 1 | | 16.844 | 2.73 | 25 | | | | | | | |
| Pooled NT 713_879 | 0 | | | | | 17.42 | 1.60 | 12 | | | | |
| Pooled NT_ 713 | 0 | | | | | 17.2 | 1.09 | 7 | | | | |
| Pooled NT_879 | 0 | | | | | 17.72 | 2.25 | 5 | | | | |
| External NT WT | 0 | | | | | 12.96 | 6.19 | 7 | | | | |
| All NT SAP + Externals | | | | | | 15.77 | 4.38 | 19 | | | | |
| External + NT713 | | | | | | 15.08 | 4.80 | 14 | | | | |
| External + NT879 | | | | | | 14.94 | 5.36 | 12 | | | | |
| All T713_Untreated | | | 18.68 | 1.11 | 7 | | | | | | | |
| All T879_Untreated | | | 16.63 | 1.41 | 8 | | | | | | | |
| All T W2_Untreated | | | 17.89 | 1.61 | 8 | | | | | | | |
| T713_879_Untreated | | | 17.58 | 1.63 | 15 | | | | | | | |
| NT713_879_Untreated | | | 18.41 | 2.86 | 7 | | | | | | | |

Example 6

Determination of Functional Homologs by Reciprocal BLAST®

A candidate sequence was considered a functional homolog of a reference sequence if the candidate and reference sequences encoded proteins having a similar function and/or activity. A process known as Reciprocal BLAST® (Rivera et al., Proc. Natl. Acad. Sci. USA, 95:6239-6244(1998)) was used to identify potential functional homolog sequences from databases consisting of all available public and proprietary peptide sequences, including NR from NCBI and peptide translations from Ceres clones.

Before starting a Reciprocal BLAST® process, a specific reference polypeptide was searched against all peptides from its source species using BLAST® in order to identify polypeptides having BLAST® sequence identity of 80% or greater to the reference polypeptide and an alignment length of 85% or greater along the shorter sequence in the alignment. The reference polypeptide and any of the aforementioned identified polypeptides were designated as a cluster.

The BLAST® version 2.0 program from Washington University at Saint Louis, Missouri, USA was used to determine BLAST® sequence identity and E-value. The BLAST® version 2.0 program includes the following parameters: 1) an E-value cutoff of 1.0e-5; 2) a word size of 5; and 3) the -postsw option. The BLAST® sequence identity was calculated based on the alignment of the first BLAST® HSP (High-scoring Segment Pairs) of the identified potential functional homolog sequence with a specific reference polypeptide. The number of identically matched residues in the BLAST® HSP alignment was divided by the HSP length, and then multiplied by 100 to get the BLAST® sequence identity. The HSP length typically included gaps in the alignment, but in some cases gaps were excluded.

The main Reciprocal BLAST® process consists of two rounds of BLAST® searches; forward search and reverse search. In the forward search step, a reference polypeptide sequence, "polypeptide A," from source species SA was BLASTed® against all protein sequences from a species of interest. Top hits were determined using an E-value cutoff of 10-5 and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original reference polypeptide was considered a potential functional homolog or ortholog as well. This process was repeated for all species of interest.

In the reverse search round, the top hits identified in the forward search from all species were BLASTed® against all protein sequences from the source species SA. A top hit from the forward search that returned a polypeptide from the aforementioned cluster as its best hit was also considered as a potential functional homolog.

Functional homologs were identified by manual inspection of potential functional homolog sequences. Representative functional homologs for SEQ ID NOs: 353, 237, 451, and 2 are shown in FIGS. 1-4, respectively. Additional exemplary homologs are correlated to certain Figures in the Sequence Listing.

Example 7

Determination of Functional Homologs by Hidden Markov Models

Hidden Markov Models (HMMs) were generated by the program HMMER 2.3.2. To generate each HMM, the default HMMER 2.3.2 program parameters, configured for global alignments, were used.

An HMM was generated using the sequences shown in FIG. 1 as input. These sequences were fitted to the model and a representative HMM bit score for each sequence is shown in the Sequence Listing. Additional sequences were fitted to the model, and representative HMM bit scores for any such additional sequences are shown in the Sequence Listing. The results indicate that these additional sequences are functional homologs of SEQ ID NO: 353.

The procedure above was repeated and an HMM was generated for each group of sequences shown in FIGS. 2-4, using the sequences shown in each Figure as input for that HMM. A representative bit score for each sequence is shown in the Sequence Listing. Additional sequences were fitted to certain HMMs, and representative HMM bit scores for such additional sequences are shown in the Sequence Listing. The results indicate that these additional sequences are functional homologs of the sequences used to generate that HMM.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (772 sequences)

SEQ ID NO: 1 - DNA, 1546 bp, Panicum virgatum
  misc_feature (1)..(1546): Ceres Clone ID no. 1752915
  misc_feature (1)..(1546): Encodes the peptide sequence at SEQ ID NO. 2
cccaagaaccccccactcccctccaccccaccccgcacccaccgcaagcgagaggcgagagccagcagccaagaagcagcagcagcagcagcagcagcagctatggtggcgcagcgccgggacgccgaggcggagctgaacctgcccccggggttccgcttccaccccaccgacgaggagctggtggcgcactacctctgcgcgcgcgccgccgggcgcggcccgccggtgcccatcatcgccgaggtcgacctctaccgcttcgacccctgggacctccccgagcgcgccctcttcggccgccgcgagtggtacttcttcacgcccagggaccgcaagtaccccaacggctcccgccccaaccgcgccgccgggacgggctactggaaagccaccggcgccgacaagcccgtccaccacgccggccgcaccctcgggatcaagaaggcgctcgtcttctaccacggcaagccgccgcgcggggtcaagaccgagtggatcatgcacgagtaccgcctcgccgacgccggcaccaagaagcccggcaacggctcgctcaggctggacgactgggtgctgtgccgcctgtacaacaagaagaacgagtgggagaagatgcagcagcagaaggggaaggcgatggagtcggaggcgtcgctctcccactcccactcccactccgacacgcgcacgccggagtcggagatcgacgacgacacgttcccggtgctgggcttgctgccggagttcgacgacatgggccccgctcccgctctcgcccccgcccccgccggcgccgtcctgcccaaggaggaggtgcaggacttcgtcaacctcggcggcgacgactggctcgcggggatcaacctcgactacctgcagatgcccggggacgccgacttcttcaacaacatgctcgggtcgccgatgggtcctcccaagccggagcaggacggcggcttcctgctattctgaacctgatgggctctgctccgattagctctgctctgctctgctccgaccccgaagagggatgcagctgcaactgtgaatagttcagatttgctttccatttagagaaacaaaaaattcctgctaatgcctggttggttgtagtgccgtagaccgtagtggtgtagtgcagaagtagtggtggtatgcaggtcagccaaggattggagtccagtgtaggactgaagctcatcattggagcttgtgatcagtgacaaaattctttcgtttctggttcagtaatttatcatcatttagatttgtttcttcagaattcagatgggcaaatgacattcagccgttttgtgttccttgtctctgaatattggatggtcatcccatttctgtttggccttttcgtttgtgatgatgatttttcagtgtgctactctttgcattcaggaattgttcttactcgatgagcaccgcgttcctttgcttccgtacaggccatgtgttctgtttgttcaaatgtagcagtggatgtttggtttctgttcagcgggtagcacagagaagaggcgatgggcagtac

SEQ ID NO: 2 - protein, 290 aa, Panicum virgatum
  misc_feature (1)..(290): Ceres Clone ID no. 1752915
  misc_feature (14)..(139): Pfam Name: NAM Pfam Description: No apical meristem (NAM) protein
  misc_feature (1)..(290): Bit score of 660.3 for HMM based on sequences of Figure 4
  misc_feature (1)..(290): in Figure 4
MVAQRRDAEAELNLPPGFRFHPTDEELVAHYLCARAAGRGPPVPIIAEVDLYRFDPWDLPERALFGRREWYFFTPRDRKYPNGSRPNRAAGTGYWKATGADKPVHHAGRTLGIKKALVFYHGKPPRGVKTEWIMHEYRLADAGTKKPGNGSLRLDDWVLCRLYNKKNEWEKMQQQKGKAMESEASLSHSHSHSDTRTPESEIDDDTFPVLGLLPEFDDMGPAPALAPAPAGAVLPKEEVQDFVNLGGDDWLAGINLDYLQMPGDADFFNNMLGSPMGPPKPEQDGGFLLF

SEQ ID NO: 3 - protein, 300 aa, Zea mays
  misc_feature (1)..(300): Public GI ID no. 239053200
  misc_feature (24)..(149): Pfam Name: NAM Pfam Description: No apical meristem (NAM) protein
  misc_feature (1)..(300): Bit score of 666.9 for HMM based on sequences of Figure 4
  misc_feature (1)..(300): Functional Homolog Of SEQ ID NO. 2
  misc_feature (1)..(300): in Figure 4
MVAMAAVQQQQQQQRRDAEAELNLPPGFRFHPTDEELVAHYLCARAAGRRPPVSIIAEVDLYRFDPWDLPERALFGRREWYFFTPRDRKYPNGSRPNRAAGSGYWKATGADKPVEHEGRTAGIKKALVFYHGKPPRGVKTEWIMHEYRLAEAGGARAKKSGAGTLRLDDWVLCRLYNKKNEWEKMQQQKEKEKKAMESEASLSHSHSDTRTPESEIDDDPFPELGSLPAFDDMGAAPAPAGVVLPKEEVEDFGDLGGDDWLAGINLDDLQMPGDAADFYGSMLVSPMAAKMEPDGGFPFF

SEQ ID NO: 4 - protein, 290 aa, Sorghum bicolor
  misc_feature (1)..(290): Public GI ID no. 242043390
  misc_feature (20)..(145): Pfam Name: NAM Pfam Description: No apical meristem (NAM) protein
  misc_feature (1)..(290): Bit score of 650.6 for HMM based on sequences of Figure 4
  misc_feature (1)..(290): Functional Homolog Of SEQ ID NO. 2
  misc_feature (1)..(290): in Figure 4
MVMTTAAQQQRRDAEAELNLPPGFRFHPTDEELVAHYLCARAAGRRPPVSIIAEVDLYRFDPWDLPERALFGRREWYFFTPRDRKYPNGSRPNRAAGSGYWKATGADKPVEHRGRTVGIKKALVFYHGKPPRGVKTEWIMHEYRLADAGGARAKKSGNGTLRLDDWVLCRLYNKKNEWEKMQQQKEKKEMESEASLSHSDTRTPESEIDDDPFPELASLPALDDMVGLAPAAGAILPKEEVEDFGDLGGDDWLAGINLDDLQMPGDADFFGNMLSPMAAKMEQDAGFPFF

SEQ ID NO: 5 - protein, 287 aa, Triticum
  misc_feature (1)..(287): Public GI ID no. 4218535
  misc_feature (1)..(287): Triticum sp.
  misc_feature (17)..(142): Pfam Name: NAM Pfam Description: No apical meristem (NAM) protein
  misc_feature (1)..(287): Bit score of 630.0 for HMM based on sequences of Figure 4
  misc_feature (1)..(287): Functional Homolog Of SEQ ID NO. 2
  misc_feature (1)..(287): in Figure 4
MVMAAAERRDAEAELNLPPGFRFHPTDEELVADYLCARAAGRAPPVPIIAELDLYRFDPWELPERALFGAREWYFFTPRDRKYPNGSRPNRAAGGGYWKATGADRPVARAGRTVGIKKALVFYHGRPSAGVKTDWIMHEYRLAGADGRAAKNGGTLRLDEWVLCRLYNKKNQWEKMQRQRQEEEAAAKAAASQSVSWGETRTPESDVDNDPFPELDSLPEFQTANASILPKEEVQELGNDDWLMGISLDDLQGPGSLMLPWDDSYAASFLSPVATMKMEQDVSPFFF

SEQ ID NO: 6 - DNA, 951 bp, Oryza sativa
  misc_feature (1)..(951): Ceres Annot ID no. 1706255
  misc_feature (1)..(951): Encodes the peptide sequence at SEQ ID NO. 7
atggggatggggatgaggagggagagggacgcggaggcggagctgaacctgccgccggggttcaggttccaccccacggacgacgagctggtggagcactacctgtgcaggaaggcggcggggcagcgcctgccggtgccgatcatcgccgaggtggatctctacaagttcgacccgtgggatctgcccgagcgcgcgctgttcggcgccagggagtggtacttcttcaccccgcgggatcgcaagtatcctaatgggtcacgccccaaccgcgccgccggcaacgggtactggaaggccaccggcgccgacaagcccgtcgcgccgcgggggcgcacgcttgggatcaagaaggcgctcgtgttctacgccggcaaggcgccgcgaggggtcaagactgattggatcatgcatgagtaccggctcgccgatgctggccgcgccgccgcgggcgccaagaagggatctctcaggttggatgattgggtgctgtgtcggctgtacaacaagaagaacgagtgggagaagatgcagcaggggaaggaggtgaaggaggaggcgtccgacatggttacgtcgcagtcgcactcgcacacccactcgtggggcgagacgcgcacgccggagtcggagatcgtggacaacgaccccttcccggagctggactcgttcccggcgttccagcctgcgccgccgccggcgacggcgatgatggtgcccaagaaagaatcgatggacgacgccaccgcggccgccgccgccgccgccaccatccccaggaacaacagcagcctgttcgtggacctgagctacgacgatatccagggcatgtacagcggcctcgacatgctgccgccgggcgacgacttctactcgtcgctcttcgcgtcgccgcgggtgaaggggacgacgccacgcgccggcgccggcatgggcatggtcccgttctga

SEQ ID NO: 7 - protein, 316 aa, Oryza sativa
  misc_feature (1)..(316): Ceres Annot ID no. 1706255
  misc_feature (17)..(142): Pfam Name: NAM Pfam Description: No apical meristem (NAM) protein
  misc_feature (1)..(316): Bit score of 663.8 for HMM based on sequences of Figure 4
  misc_feature (1)..(316): Functional Homolog Of SEQ ID NO. 2
  misc_feature (1)..(316): in Figure 4
MGMGMRRERDAEAELNLPPGFRFHPTDDELVEHYLCRKAAGQRLPVPIIAEVDLYKFDPWDLPERALFGAREWYFFTPRDRKYPNGSRPNRAAGNGYWKATGADKPVAPRGRTLGIKKALVFYAGKAPRGVKTDWIMHEYRLADAGRAAAGAKKGSLRLDDWVLCRLYNKKNEWEKMQQGKEVKEEASDMVTSQSHSHTHSWGETRTPESEIVDNDPFPELDSFPAFQPAPPPATAMMVPKKESMDDATAAAAAAATIPRNNSSLFVDLSYDDIQGMYSGLDMLPPGDDFYSSLFASPRVKGTTPRAGAGMGMVPF

SEQ ID NO: 8 - protein, 303 aa, Elaeis guineensis
  misc_feature (1)..(303): Public GI ID no. 82400207
  misc_feature (14)..(141): Pfam Name: NAM Pfam Description: No apical meristem (NAM) protein
  misc_feature (1)..(303): Bit score of 700.5 for HMM based on sequences of Figure 4
  misc_feature (1)..(303): Functional Homolog Of SEQ ID NO. 2
  misc_feature (1)..(303): in Figure 4
MGSRRRDAEAELNLPPGFRFHPTDEELVVHYLCKKVACQRLPVPIIAEVDLYKYDPWDLPEKALFGLKEWYFFTPRDRKYPNGSRPNRAAGRGYWKATGADKPVTPKGSSRPLGIKKALVFYSGKAPRGVKTDWIMHEYRLADTNRAANKKGSLRLDDWVLCRLYNKKNTWEKMQQQKEAASFGETMDSVDDTGSDSFRTPESDIDNDVMFPDFDDMAQVGAHPPQAFNGMQGVRVNNITGYQPAIEQRPKEENDWFTDLNLDDFHSTCMAFGSTPALDMSDHDYYYSNLPQLRSNQSDLLPF

SEQ ID NO: 9 - protein, 316 aa, Hordeum vulgare
  misc_feature (1)..(316): Public GI ID no. 326514348
  misc_feature (1)..(316): Hordeum vulgare subsp. vulgare
  misc_feature (30)..(158): Pfam Name: NAM Pfam Description: No apical meristem (NAM) protein
  misc_feature (1)..(316): Bit score of 646.4 for HMM based on sequences of Figure 4
  misc_feature (1)..(316): Functional Homolog Of SEQ ID NO. 2
  misc_feature (1)..(316): in Figure 4
MMTAMVKAEAMTAEAEGSSGRRDAEAELNLPPGFRFHPTDDELVVHYLCRKVAGQPQPVPIIAEVDLYKFNPWDLPERALFGSREWYFFTPRDRKYPNGSRPNRSAGTGYWKATGADKPVAPRESGGRTVGIKKALVFYSGRAPRGVKTDWIMHEYRIAQADRTPGKKGSLKLDEWVLCRLYNKKNNWDKVKVEQDMAVVQGQNGEVMDALATDAMSDSFQTHDSSEIDNASGLQQQHHGFMDMAQRQAREGMVTVKEDSDWFTGLSMDDLQTCYMNMGQMVNPAAMPVHDGSGYLQSMNSPQMMRPMWQTILPPF

SEQ ID NO: 10 - protein, 297 aa, Vitis vinifera
  misc_feature (1)..(297): Public GI ID no. 225435840
  misc_feature (13)..(140): Pfam Name: NAM Pfam Description: No apical meristem (NAM) protein
  misc_feature (1)..(297): Bit score of 635.2 for HMM based on sequences of Figure 4
  misc_feature (1)..(297): Functional Homolog Of SEQ ID NO. 2
  misc_feature (1)..(297): in Figure 4
MKRERDAEAELNLPPGFRFHPTDEELVVHYLCRKASYQTLPVPIIVEIDLYKYDPWQLPEKALFGIKEWYFFTPRDRKYPNGSRPNRAAGNGYWKATGADKPVRPTGSTKAVGIKKALVFYSGKAPKGTKTDWIMHEYRLAQPNRSSDKKSSLRLDDWVLCRIYNKKNNWREKMQHQMNQLLPHEPIDPFEVAEDDGSDSLRTPESDIDIETLSYNHDLHGAQGQGYSYQVLHDNNLQITDTDSGFPARECFKEEDDYWLTNLNLEDLQNSLTTFGTMPLPDFSYQDSFSMIHGLPY

SEQ ID NO: 11 - protein, 300 aa, Crocus sativus
  misc_feature (1)..(300): Public GI ID no. 155965519
  misc_feature (14)..(142): Pfam Name: NAM Pfam Description: No apical meristem (NAM) protein
  misc_feature (1)..(300): Bit score of 625.4 for HMM based on sequences of Figure 4
  misc_feature (1)..(300): Functional Homolog Of SEQ ID NO. 2
  misc_feature (1)..(300): in Figure 4
MGRRTADAEANLNLPPGFRFHPTDEELVVHYLCKKIISQRLPAAIIAEVDLYKYYPWQLPEKALFGHKEWYFLTPRDRKYPNGSRPNRAAGRGYWKATGADKPIAPKGGSSKPLGIKKALVFYSGKAPRGTKTDWIMHEYRLADSHRTASKKGSLRLDDWVLCRLYHKKNSWETKMQQHSSFGETKDSSFEAADDAGSDSFRPDIEHEPYPEFEEDLAKPTVYPPQTSDGMQAARTSNTVKQRVKEDNDWFMDLTLDDLQSPLEMFGTSTADLDVSNQDYFFQMLNSTQMKTSLTNLPPF

SEQ ID NO: 12 - protein, 387 aa, Picea sitchensis
  misc_feature (1)..(387): Public GI ID no. 116791569
  misc_feature (12)..(139): Pfam Name: NAM Pfam Description: No apical meristem (NAM) protein
  misc_feature (1)..(387): Bit score of 665.0 for HMM based on sequences of Figure 4
  misc_feature (1)..(387): Functional Homolog Of SEQ ID NO. 2
  misc_feature (1)..(387): in Figure 4
MGRPNAEAQLNLPPGFRFFPTDDELVVHYLCRKAASQAIAVPIIAEVDLYKFDPWQLPEKALFGEKEWYFFTPRDRKYPNGSRPNRAAGSGYWKATGADKPITAKGSNKRVGIKKALVFYVGKAPKGNKTNWIMHEYRLADVNRSAKKKGSLRLDDWVLCRIYNKKSSAEKLAKEQKEWSSEEAMEQFHEEIDEKVPGILPTGNTIMNSSIEHSERTSQDSTISAPSPNCRTASNHDSRASAITSLSYNSNPIFEQNLNLSNARSAPMEIPELVPFFSSMNNHRTNYDSADLIPPILLTDSSCSMQSSHDLKSEKEEVQSSFRLEELMQQQQQENAGLNQQMFSFGFESLQNPFPSLDQIQPPTNNDPFQDYLASLTVPSYLQRSSY

SEQ ID NO: 13 - protein, 295 aa, Prunus mume
  misc_feature (1)..(295): Public GI ID no. 82568708
  misc_feature (8)..(132): Pfam Name: NAM Pfam Description: No apical meristem (NAM) protein
  misc_feature (1)..(295): Bit score of 671.3 for HMM based on sequences of Figure 4
  misc_feature (1)..(295): Functional Homolog Of SEQ ID NO. 2
  misc_feature (1)..(295): in Figure 4
MSSSDLQLPPGFRFHPTDEELVKHYLCRKCQSQPISVPIIAEIDLYKYNPWDLPGLALYGEKEWYFFSPRDRKYPNGSRPNRAAGSGYWKATGADKPIGSPKPVGIKKALVFYAGKAPRGEKTNWIMHEYRLADVDRSPRKKSSSLRLDDWVLCRIYNKKGTVEKQQQQQQQQQQQTTSRMSSGSEFEDRKPENLACPPPPAAVAPTRPNDYVYFDTSDSVPRLHTDSSCSEHVVSPEFTCEVQSEPKWKEWEKALDFNYNYMDTSVENGFGPQFQSANQMSPLQDIFMYLQKPY

SEQ ID NO: 14 - protein, 304 aa, Petunia x hybrida
  misc_feature (1)..(304): Public GI ID no. 21105748
  misc_feature (8)..(132): Pfam Name: NAM Pfam Description: No apical meristem (NAM) protein
  misc_feature (1)..(304): Bit score of 679.7 for HMM based on sequences of Figure 4
  misc_feature (1)..(304): Functional Homolog Of SEQ ID NO. 2
  misc_feature (1)..(304): in Figure 4
MTTAELQLPPGFRFHPTDEELVMHYLCRKCASQPIAVPIIAEIDLYKYDPWDLPDLALYGEKEWYFFSPRDRKYPNGSRPNRAAGTGYWKATGADKPIGHPKAVGIKKALVFYAGKAPKGEKTNWIMHEYRLADVDRSARKNNNSLRLDDWVLCRIYNKKGSIEKNQLNNKKIMNTSYMDMTVSSEEDRKPEILPPLPPQPAPQQQQVYNDFFYLDPSDSVPKIHSDSSCSEHVVSPEFTCEREVQSEAKLSEWEKAALDLPFNYMDATTGATTLDNSLLGSQFQSSYQMSPLQDMFMHLHKPF

SEQ ID NO: 15 - protein, 303 aa, Avicennia marina
  misc_feature (1)..(303): Public GI ID no. 154362215
  misc_feature (10)..(134): Pfam Name: NAM Pfam Description: No apical meristem (NAM) protein
  misc_feature (1)..(303): Bit score of 682.7 for HMM based on sequences of Figure 4
  misc_feature (1)..(303): Functional Homolog Of SEQ ID NO. 2
  misc_feature (1)..(303): in Figure 4
MKGGDQQLNLPAGFRFHPTDEELVVHYLCRKCAGQQIGVPVIAEIDLYKFDPWELPDLALYGEKEWYFFSPRDRKYPNGSRPNRAAGTGYWKATGADKPVGKPKTLGIKKALVFYAGKAPRGVKTNWIMHEYRLANVDRSAGKTKNLRLDDWVLCRIYNKKGTLEKHLSVDQKEVQFSDSEEQKPEVDAFPFGDMVMPGPAPPVQAPVTLASQRMNDYMHFDASDSFPKLHTDSSSSEHVLSPEFMCDKEVQSAPKWSELESTLDFPLIYMDGFQDDPFGSQMQYGDQLSLFPDMYAYMQKPF

SEQ ID NO: 16 - DNA, 1182 bp, Panicum virgatum
  misc_feature (1)..(1182): Ceres Clone ID no. 1804251
  misc_feature (1)..(1182): Encodes the peptide sequence at SEQ ID NO. 17
aagaaccccccactccactccactcaatccgcctcagccgcagccggccaccccacccaccgcaaggagcgagagccaccaaccaagaagcagccatggtgacggcggcggccgcgacgcagcgccgtgacgccgaggcggagctgaacctgcccccgggcttccgcttccaccccaccgacgaggagctcgtcgcgcactacctctgcgcgcgcgccgccgggcgcagcgcgccggtgcccatcatcgccgaggtcgacctctaccgcttcgacccctgggagctccccgagcgcgccctcttcggccgccgcgagtggtacttcttcacgccgagggaccgcaagtaccccaacggctcccgccccaaccgcgccgccgggaccgggtactggaaggccaccggcgccgacaagcccatccagcacgggggccggaccctggggatcaagaaggcgctcgtcttctaccacgggaagccgccgcgcgggatcaagaccgagtggatcatgcacgagtaccgcctcgccgacgccggcggcaagaagcccggcaacggctcgctcaggctggacgactgggtgctgtgccgcctctacaacaagaagaacgagtgggagaagatgcagcagcagaaggagaaggcaatgaagtcggaggcgtcgctctcgcactcccactcccactccgacacgcgcacgccggagtcggagatcgacgacgacacgttcccggggctgggctcgctgccggagttcgacggcatgcgccccgcccccgccggcgccgtcctgcccaaggaggaggtgcaggacttcggcaacctcggcggcgacgactggctcgcggggatcaacctcgactacctgcaggtgcccggggacgccgacttcttcaacaacatgaccctattctgaacctgagctctgctccgatttgctctgctctgctctgctccgaccccgaggagggatgcagctgcaactgtgaatagttcagatttgctttccattcagagaaacaaaaattattcctgctaatgcctggttgtagtgccgtagaccgtagtggtgtcgtgcagtagtggtatgcaggtcagcatggattggagtccagtataggattgaagctcatcattggagcttgtgatcagtgacaaaattctttcgtttctggttcagc

SEQ ID NO: 17 - protein, 273 aa, Panicum virgatum
  misc_feature (1)..(273): Ceres Clone ID no. 1804251
  misc_feature (19)..(144): Pfam Name: NAM Pfam Description: No apical meristem (NAM) protein
  misc_feature (1)..(273): Bit score of 603.5 for HMM based on sequences of Figure 4
  misc_feature (1)..(273): Functional Homolog Of SEQ ID NO. 2
MVTAAAATQRRDAEAELNLPPGFRFHPTDEELVAHYLCARAAGRSAPVPIIAEVDLYRFDPWELPERALFGRREWYFFTPRDRKYPNGSRPNRAAGTGYWKATGADKPIQHGGRTLGIKKALVFYHGKPPRGIKTEWIMHEYRLADAGGKKPGNGSLRLDDWVLCRLYNKKNEWEKMQQQKEKAMKSEASLSHSHSHSDTRTPESEIDDDTFPGLGSLPEFDGMRPAPAGAVLPKEEVQDFGNLGGDDWLAGINLDYLQVPGDADFFNNMTLF

SEQ ID NO: 18 - DNA, 1314 bp, Zea mays
  misc_feature (1)..(1314): Ceres Clone ID no. 219367
  misc_feature (1)..(1314): Encodes the peptide sequence at SEQ ID NO. 19
  misc_feature (188)..(188): s is g or c
ccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggasctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgccctcttcgggcgccgcaagtggtacttcttcacgccgcgggaccgcaagtaccccaacggctcccgccccaaccgcgccgccgggtcgggctactggaaggccacgggcgcggacaagcccgtggagcacgagggccggacggcggggatcaagaaggcgctcgtgttctaccacggcaagccgccgcgcggggtcaagacggagtggatcatgcacgagtaccgcctcgccgaagccggcggcgcccgcgccaagaagtccggcgccggcacgctcaggctggatgactgggtgctgtgccgcctgtacaacaagaagaacgagtgggagaagatgcagcagcagaaggagaaggagaagaaggcgatggagtcggaggcgtcgctctcgcactcccactccgacacgcggacgccggaatcggagatcgacgacgacccgttcccggagctgggctctctaccggcgttcgacgacatgggcgcagccccagcccctgccggcgtcgtcctgcccaaggaggaggtggaggacttcggcgacctcggcggcgacgactggctcgcgggcatcaacctcgacgacctgcagatgccgggggacgccgccgatttctacggctccatgctcgtctcgccgatggccgccaagatggagccggacggcggcttccccttcttctgagatccttcggcgactccggggacgaccggatgcagcgcaacgcaaactgtgtatagttcagattttcttcatggaaccaacaacaacaaaaaaagttcttgctaatatcttgttctagtggtgtagtgcagaagtagcagcaacatgattgaagttccattgtagtactgatgttcatcgccacttgagctgtgacaagtgacgacattctttcgtttcttggctgcaaattcttcgttgtccagaatataatttcagatgggtaatgccaattcgggacgtgttg

SEQ ID NO: 19 - protein, 300 aa, Zea mays
  misc_feature (1)..(300): Ceres Clone ID no. 219367
  misc_feature (24)..(149): Pfam Name: NAM Pfam Description: No apical meristem (NAM) protein
  misc_feature (1)..(300): Bit score of 657.2 for HMM based on sequences of Figure 4
  misc_feature (1)..(300): Functional Homolog Of SEQ ID NO. 2
  misc_feature (21)..(21): Xaa is any aa, unknown or other
MVAMAAVQQQQQQQRRDAEAXLNLPPGFRFHPTDEELVAHYLCARAAGRRPPVSIIAEVDLYRFDPWDLPERALFGRRKWYFFTPRDRKYPNGSRPNRAAGSGYWKATGADKPVEHEGRTAGIKKALVFYHGKPPRGVKTEWIMHEYRLAEAGGARAKKSGAGTLRLDDWVLCRLYNKKNEWEKMQQQKEKEKKAMESEASLSHSHSDTRTPESEIDDDPFPELGSLPAFDDMGAAPAPAGVVLPKEEVEDFGDLGGDDWLAGINLDDLQMPGDAADFYGSMLVSPMAAKMEPDGGFPFF

SEQ ID NO: 20 - protein, 303 aa, Zea mays
  misc_feature (1)..(303): Public GI ID no. 226528637
  misc_feature (22)..(147): Pfam Name: NAM Pfam Description: No apical meristem (NAM) protein
  misc_feature (1)..(303): Bit score of 646.4 for HMM based on sequences of Figure 4
  misc_feature (1)..(303): Functional Homolog Of SEQ ID NO. 2
MVMAPAAAQQQRRRDAEAELNLPPGFRFHPTDEELVAHYLCARAAGRRPPVSIIAEVDLYRFDPWDLPERALFGRREWYFFTPRDRKYPNGSRPNRAAGSGYWKATGADKPVEHGGRTVGVKKALVFYHGKPPRGVKTEWIMHEYRLADAGARARARKPGTGTLRLDDWVLCRLYNKKNEWEKTQQQQEKKQNQKQMESEASLSHSHSDTRTPESEIDDDPFPELASLPALDDMMGPAAAAPAGAILPKEEVEDLGGLGGDDWLAGINLDDLQIPGEADFYGSMLVSPMAAKMEQDAAGFPFF

SEQ ID NO: 21 - DNA, 1222 bp, Zea mays
  misc_feature (1)..(1222): Ceres Clone ID no. 100906935
  misc_feature (1)..(1222): Encodes the peptide sequence at SEQ ID NO. 22
  misc_feature (670)..(670): y is t/u or c
  misc_feature (682)..(682): y is t/u or c
  misc_feature (712)..(712): s is g or c
ccggccaacacccgcaccgcagtccacagcaagaaccaagccacagcgaagaaaagatccaatggtgatggcgccggcggcggcgcagcagcagcggcgccgcgacgcggaggcggagctgaacctgcccccgggcttccggttccacccgacggacgaggagctggtggcgcactacctctgcgcgcgcgccgcgggtcgccgccccccggtgtccatcatcgccgaggtcgacctctaccgcttcgacccctgggacctgcccgagcgcgccctcttcggccgccgcgagtggtacttcttcacgccgcgggaccgcaagtaccccaatggctcccgccccaaccgcgccgccgggtcggggtactggaaggccacgggagcggacaagcccgtggagcacggtggcaggacggtcggcgtcaagaaggcgctcgtgttctaccacggcaagccgccgcgcggggtcaagacggagtggatcatgcacgagtaccgcctcgccgacgccggcgcccgcgcccgcgccaggaagcccggcaccggcacgctcaggttggatgactgggtgctctgccggctgtacaacaagaagaacgagtgggagaagacgcagcagcagcaggagaagaagcagaatcagaagcaaatggagtcggaggcctcgctytcgcactcccaytcagacacgcggacgccggagtcggagatsgacgacgacccgttcccggagctggcctcgctgccggcactcgacgacatgatgggcccagcagcagcagcgcctgccggcgccattttgcccaaggaggaggtggaagacttgggcggcctcggcggggacgactggctcgcgggcatcaacctcgacgacctgcagatcccgggcgaggccgacttttatggctccatgctcgtgtcgccgatggccgccaagatggagcaggacgccgccggcttcccgtttttttgagaccttttgcgcaacgcaaactgtgtatagttcagattttttcaggattcggagaaaaaaacagttttgttgatatttggttgtagtggtttagtgcacaagcagcagtatgccggtcagttaagattgaagtccattgtagttcatccccacttgagctgtgactgtgataagtgacagcattctttcatttttggtttgttaatttttcaatggtcagaatatagtttgtggccttcccagagtggt

SEQ ID NO: 22 - protein, 303 aa, Zea mays
  misc_feature (1)..(303): Ceres Clone ID no. 100906935
  misc_feature (22)..(147): Pfam Name: NAM Pfam Description: No apical meristem (NAM) protein
  misc_feature (1)..(303): Bit score of 639.5 for HMM based on sequences of Figure 4
  misc_feature (1)..(303): Functional Homolog Of SEQ ID NO. 2
  misc_feature (203)..(203): Xaa is any aa, unknown or other
  misc_feature (207)..(207): Xaa is any aa, unknown or other
  misc_feature (217)..(217): Xaa is any aa, unknown or other
MVMAPAAAQQQRRRDAEAELNLPPGFRFHPTDEELVAHYLCARAAGRRPPVSIIAEVDLYRFDPWDLPERALFGRREWYFFTPRDRKYPNGSRPNRAAGSGYWKATGADKPVEHGGRTVGVKKALVFYHGKPPRGVKTEWIMHEYRLADAGARARARKPGTGTLRLDDWVLCRLYNKKNEWEKTQQQQEKKQNQKQMESEASXSHSXSDTRTPESEXDDDPFPELASLPALDDMMGPAAAAPAGAILPKEEVEDLGGLGGDDWLAGINLDDLQIPGEADFYGSMLVSPMAAKMEQDAAGFPFF

SEQ ID NO: 23 - DNA, 768 bp, Panicum virgatum
  misc_feature (1)..(768): Ceres Clone ID no. 1902485
  misc_feature (1)..(768): Encodes the peptide sequence at SEQ ID NO. 24
aagaaccccccactccactccaccccaccccgcacccaccgcaagcgagaggcgagagccagcagccaagcagcagcagcagcagcagctatggtggcgcagcgccgggacgccgaggcggagctgaacctgcccccggggttccgcttccaccccaccgacgaggagctggtggcgcactacctctgcgcgcgcgccgccgggcgcggcccgccggtacccatcatcgccgaggtcgacctctaccgcttcgacccctgggacctccccgagcgcgccctcttcggccgccgcgagtggtacttcttcacgcccagggaccgcaagtaccccaacggctcccgccccaaccgcgccgccgggacgggctactggaaggccaccggcgccgacaagcccgtccaccacgccggccgcaccctcgggatcaagaaggcgctcgtcttctaccacggcaagccgccgcgcggggtcaagaccgagtggatcatgcacgagtaccgcctcgccgacgccggcgccaagaagcccggcaacggctcgctcaggctggacgactgggtgctgtgccgcctgtacaacaagaagaacgagtgggagaagatgcagcagcagaaggggaaggcgatggagtcggaggcgtcgctctcccactcccactcccactcccactccgacacgcgcacgccggagtcggagatcgacgacgacacgttcccggtgctgggcttgctgccggagttcgacgacttggggcccgctcccgcc

SEQ ID NO: 24 - protein, 226 aa, Panicum virgatum
  misc_feature (1)..(226): Ceres Clone ID no. 1902485
  misc_feature (14)..(139): Pfam Name: NAM Pfam Description: No apical meristem (NAM) protein
  misc_feature (1)..(226): Bit score of 480.4 for HMM based on sequences of Figure 4
  misc_feature (1)..(226): Functional Homolog Of SEQ ID NO. 2
MVAQRRDAEAELNLPPGFRFHPTDEELVAHYLCARAAGRGPPVPIIAEVDLYRFDPWDLPERALFGRREWYFFTPRDRKYPNGSRPNRAAGTGYWKATGADKPVHHAGRTLGIKKALVFYHGKPPRGVKTEWIMHEYRLADAGAKKPGNGSLRLDDWVLCRLYNKKNEWEKMQQQKGKAMESEASLSHSHSHSHSDTRTPESEIDDDTFPVLGLLPEFDDLGPAPA

SEQ ID NO: 25 - DNA, 874 bp, Triticum aestivum
  misc_feature (1)..(874): Ceres Clone ID no. 754901
  misc_feature (1)..(874): Encodes the peptide sequence at SEQ ID NO. 26
  misc_feature (5)..(5): y is t/u or c
  misc_feature (635)..(635): k is g or t/u
cattycgagacactcaacacagtccaccacgcacgtgcagcagcagcagcgcccgagaatcccattcccatcgacggagaagaagaagtgaagaaacaatggtgatggcagcggcggagcggcgggacgcggaggcggagctgaacctgccgccggggttccggttccacccgacggacgaggagctggtggcggactacctctgcgcgcgcgcggccggccgcgcgccgccggtgcccatcatcgccgagctcgacctctaccggttcgacccgtgggagctcccggagcgggcgctcttcggggcgcgggagtggtacttcttcacgccgcgggaccgcaagtaccccaacggctcccgccccaaccgggccgccgggggcggctactggaaggccaccggcgccgacaggcccgtggcgcgcgcgggcaggaccgtcgggatcaagaaggcgctcgtcttctaccacggcaggccgtcggcgggggtcaagacggactggatcatgcacgagtaccgcctcgccggcgccgacggacgcgccgccaagaacggcggcacgctcaggcttgacgactgggtgctctgccgcctatacaacaagaagaaccagtgggagaagatgcagcggcakcggcaggaggaggaggcggcggccaaggctgcggcgtcacagtcggtctcctggggtgagacgcggacgccggagtccgacgtcgacaacgatccgttcccggagctggactcgctgccggagttccagacggcaaacgcgtcaatactgcccaaggaggaggtgcaggagctgggcaacgacgactggctcatggggatcagcctcgacgacctgccggcacgagaagccggcacgag

SEQ ID NO: 26 - protein, 258 aa, Triticum aestivum
  misc_feature (1)..(258): Ceres Clone ID no. 754901
  misc_feature (17)..(142): Pfam Name: NAM Pfam Description: No apical meristem (NAM) protein
  misc_feature (1)..(258): Bit score of 547.1 for HMM based on sequences of Figure 4
  misc_feature (1)..(258): Functional Homolog Of SEQ ID NO. 2
  misc_feature (179)..(179): Xaa is any aa, unknown or other
MVMAAAERRDAEAELNLPPGFRFHPTDEELVADYLCARAAGRAPPVPIIAELDLYRFDPWELPERALFGAREWYFFTPRDRKYPNGSRPNRAAGGGYWKATGADRPVARAGRTVGIKKALVFYHGRPSAGVKTDWIMHEYRLAGADGRAAKNGGTLRLDDWVLCRLYNKKNQWEKMQRXRQEEEAAAKAAASQSVSWGETRTPESDVDNDPFPELDSLPEFQTANASILPKEEVQELGNDDWLMGISLDDLPAREAGT

SEQ ID NO: 27 - DNA, 654 bp, Panicum virgatum
  misc_feature (1)..(654): Ceres Clone ID no. 1804740
  misc_feature (1)..(654): Encodes the peptide sequence at SEQ ID NO. 28
aagaaccccccactccactccactcaacccgcctcagccgcagccggccaccccacccaccgcaaggagcgagagccaccaaccaagaagcagccatggtgacggcggccgcgacgcagcgccgtgacgccgaggcggagctgaacctgcccccgggcttccgcttccaccccaccgacgaggagctcgtcgcgcactacctctgcgcgcgcgccgccgggcgcagcgcgccggtgcccatcatcgccgaggtcgacctctaccgcttcgacccctgggagctccccgagcgcgccctcttcggccgccgcgagtggtacttcttcacgccgagggaccgcaagtaccccaacggctcccgccccaaccgcgccgccgggaccgggtactggaaggccaccggcgccgacaagcccgtccagcacgggggccggaccctggggatcaagaaggcgctcgtcttctaccacgggaagccgccgcgcgggatcaagaccgagtggatcatgcacgagtaccgcctcgccgacgccggcggcaagaagcccggcaacggctcgctcaggctggacgactgggtgctgtgccgcctctacaacaagaagaacgagtgggagaagatgcagcagcagaaggagaaggcaatggagtcgg

SEQ ID NO: 28 - protein, 186 aa, Panicum virgatum
  misc_feature (1)..(186): Ceres Clone ID no. 1804740
  misc_feature (18)..(143): Pfam Name: NAM Pfam Description: No apical meristem (NAM) protein
  misc_feature (1)..(186): Bit score of 375.3 for HMM based on sequences of Figure 4
  misc_feature (1)..(186): Functional Homolog Of SEQ ID NO. 2
MVTAAATQRRDAEAELNLPPGFRFHPTDEELVAHYLCARAAGRSAPVPIIAEVDLYRFDPWELPERALFGRREWYFFTPRDRKYPNGSRPNRAAGTGYWKATGADKPVQHGGRTLGIKKALVFYHGKPPRGIKTEWIMHEYRLADAGGKKPGNGSLRLDDWVLCRLYNKKNEWEKMQQQKEKAMES

SEQ ID NO: 29 - protein, 314 aa, Oryza sativa
  misc_feature (1)..(314): Public GI ID no. 88770831
  misc_feature (1)..(314): Oryza sativa Indica Group
  misc_feature (15)..(140): Pfam Name: NAM Pfam Description: No apical meristem (NAM) protein
  misc_feature (1)..(314): Bit score of 657.9 for HMM based on sequences of Figure 4
  misc_feature (1)..(314): Functional Homolog Of SEQ ID NO. 2
MGMRRERDAEAELNLPPGFRFHPTDDELVEHYLCRKAAGQRLPVPIIAEVDLYKFDPWDLPERALFGAREWYFFTPRDRKYPNGSRPNRAAGNGYWKATGADKPVAPRGRTLGIKKALVFYAGKAPRGVKTDWIMHEYRLADAGRAAAGAKKGSLRLDDWVLCRLYNKKNEWEKMQQGKEVKEEASDMVTSQSHSHTHSWGETRTPESEIVDNDPFPELDSFPAFQPAPPPATAMMVPKKESMDDATAAAAAAATIPRNNSSLFVDLSYDDIQGMYSGLDMLPPGDDFYSSLFASPRVKGTTPRAGAGMGMVPF

SEQ ID NO: 30 - DNA, 710 bp, Zea mays
  misc_feature (1)..(710): Ceres Clone ID no. 100885834
  misc_feature (1)..(710): Encodes the peptide sequence at SEQ ID NO. 31
ttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgccctcttcgggcgccgcgagtggtacttcttcacgccgcgggaccgcaagtaccccaacggctcccgccccaaccgcgccgccgggtcgggctactggaaggccacgggcgcggacaagcccgtggagcacgagggccggacggcggggatcaagaaggcgctcgtgttctaccacggcaagccgccgcgcggggtcaagacggagtggatcatgcacgagtaccgcctcgccgaagccggcggcgcccgcgccaagaagtccggcgccggcacgctcaggctggatgactgggtgctgtgccgcctgtacaacaagaagaacgagtgggagaagatgcagcagcagagggagaaggagaagaaggcgatggagtcggaggcgtcgctctcgcactcccactcc

SEQ ID NO: 31 - protein, 207 aa, Zea mays
  misc_feature (1)..(207): Ceres Clone ID no. 100885834
  misc_feature (24)..(149): Pfam Name: NAM Pfam Description: No apical meristem (NAM) protein
  misc_feature (1)..(207): Bit score of 400.3 for HMM based on sequences of Figure 4
  misc_feature (1)..(207): Functional Homolog Of SEQ ID NO. 2
MVAMAAVQQQQQQQRRDAEAELNLPPGFRFHPTDEELVAHYLCARAAGRRPPVSIIAEVDLYRFDPWDLPERALFGRREWYFFTPRDRKYPNGSRPNRAAGSGYWKATGADKPVEHEGRTAGIKKALVFYHGKPPRGVKTEWIMHEYRLAEAGGARAKKSGAGTLRLDDWVLCRLYNKKNEWEKMQQQREKEKKAMESEASLSHSHS

SEQ ID NO: 32 - protein, 276 aa, Oryza sativa
  misc_feature (1)..(276): Public GI ID no. 125557725
  misc_feature (1)..(276): Oryza sativa Indica Group
  misc_feature (17)..(142): Pfam Name: NAM Pfam Description: No apical meristem (NAM) protein
  misc_feature (1)..(276): Bit score of 517.0 for HMM based on sequences of Figure 4
  misc_feature (1)..(276): Functional Homolog Of SEQ ID NO. 2
MAAAKRRVRDAEADLNLPPGFRFHPTDEELVAHYLCPRAAGRAAPVPIIAELDLYRHDPWDLPHRALFGRREWYFFTPRDRKYPNGSRPNRAAASGYWKATGADKPVLHNGRTAGIKKALVFYHGKPPRGVKTEWIMHEYRLAKKGSAAAAAGAGALRLDDWVLCRLYNKKNEWEKMQSRKEEEEAMAAAQSWGETRTPESEVVDSDAFPEMDYSLPAASFDDALLPKEEARDDDWLMGMSLDDLQGLGSLLQADDLSMLAPPPAAKTEPLGAPFF

SEQ ID NO: 33 - protein, 276 aa, Oryza sativa
  misc_feature (1)..(276): Public GI ID no. 115471229
  misc_feature (1)..(276): Oryza sativa Japonica Group
  misc_feature (17)..(142): Pfam Name: NAM Pfam Description: No apical meristem (NAM) protein
  misc_feature (1)..(276): Bit score of 518.5 for HMM based on sequences of Figure 4
  misc_feature (1)..(276): Functional Homolog Of SEQ ID NO. 2
MAAAKRRVRDAEADLNLPPGFRFHPTDEELVAHYLCPRAAGRAAPVPIIAELDLYRHDPWDLPHRALFGRREWYFFTPRDRKYPNGSRPNRAAASGYWKATGADKPVLHNGRTAGIKKALVFYHGKPPRGVKTEWIMHEYRLAKKGGAAAAAGAGALRLDDWVLCRLYNKKNEWEKMQSRKEEEEAMAAAQSWGETRTPESEVVDSDAFPEMDYSLPAASFDDALLPKEEARDDDWLMGMSLDDLQGLGSLLQADDLSMLAPPPAAKTEPLGAPFF

SEQ ID NO: 34 - DNA, 960 bp, Sorghum bicolor
  misc_feature (1)..(960): Ceres Annot ID no. 8631975
  misc_feature (1)..(960): Encodes the peptide sequence at SEQ ID NO. 35
atgggattgccggtgatgaggagggagagggacgcggaggcggagctgaacctgccgccggggttccggttccaccccacagacgacgagctggtggagcactacctgtgccggaaagcggcggggcagcgcctcccggtgcccatcatcgcggaggtggacctatacaagttcgacccctgggacctgccggagcgcgcgctgttcggggtcagggagtggtacttcttcacgcccagggaccgcaagtacccaaacgggtcccgccccaaccgcgccgccggcaacgggtactggaaggccaccggcgccgacaagcccgtcgcgccgcggggccgcacgctcgggatcaagaaggcgctcgtcttctacgccgggaaggcgccgcgtggggtcaagacggactggatcatgcacgagtacaggctcgcggacgccggccgcgcagccgcctccaagaagggatcgctcaggctggatgactgggtgctgtgccgcctgtacaataagaagaacgagtgggagaagatgcagctggggaaggagtccgccgccggcgtcggcaccgccaaggaggaggcgatggacatgaccacctcgcactcgcactcccactcgcagtcgcactcgcactcgtggggcgagacgcgcacgccggagtcggagatcgtggacaacgacccgttcccggagctggactcgttcccggcgttccaggacccggcggcggcgatgatgatggtgcccaagaaggagcaggtggacgacggcagcgccgccgccaacgccgccaagagcagcgacctgttcgtggaccttagctacgacgacatccagggcatgtacagcggcctcgacatgctgcccccgccaggggaggacttcttctcctcgctcttcgcgtcgcccagggtcaaggggaaccagcccgccggagccgccgggttggggccattctga

SEQ ID NO: 35 - protein, 319 aa, Sorghum bicolor
  misc_feature (1)..(319): Ceres Annot ID no. 8631975
  misc_feature (18)..(143): Pfam Name: NAM Pfam Description: No apical meristem (NAM) protein
  misc_feature (1)..(319): Bit score of 620.8 for HMM based on sequences of Figure 4
  misc_feature (1)..(319): Functional Homolog Of SEQ ID NO. 2
MGLPVMRRERDAEAELNLPPGFRFHPTDDELVEHYLCRKAAGQRLPVPIIAEVDLYKFDPWDLPERALFGVREWYFFTPRDRKYPNGSRPNRAAGNGYWKATGADKPVAPRGRTLGIKKALVFYAGKAPRGVKTDWIMHEYRLADAGRAAASKKGSLRLDDWVLCRLYNKKNEWEKMQLGKESAAGVGTAKEEAMDMTTSHSHSHSQSHSHSWGETRTPESEIVDNDPFPELDSFPAFQDPAAAMMMVPKKEQVDDGSAAANAAKSSDLFVDLSYDDIQGMYSGLDMLPPPGEDFFSSLFASPRVKGNQPAGAAGLGPF

SEQ ID NO: 36 - protein, 315 aa, Oryza sativa
  misc_feature (1)..(315): Public GI ID no. 261349144
  misc_feature (1)..(315): Oryza sativa Indica Group
  misc_feature (15)..(140): Pfam Name: NAM Pfam Description: No apical meristem (NAM) protein
  misc_feature (1)..(315): Bit score of 623.7 for HMM based on sequences of Figure 4
  misc_feature (1)..(315): Functional Homolog Of SEQ ID NO. 2
MGMRRERDAEAELNLPPGFRFHPTDDELVEHYLCRKAAGQRLPVPIIAEVDLYKFDPWDLPERAPFGAREWYFFTPRDRKYPNGSRPNRAAGNGYWKATGADKPVAPRGRTLGIKKALVFYAGKAPRGVKTDWIMHEYRLADAGRARPRAPRRDLSRLDDWVLCRLYNKKNEWEKMQQGKEVKEEASDMVTSQSHSHTHSWGETRTPESEIVDNDPFPELDSFPAFQPAPPPATAMMVPKKESMDDATAAAAAAATIPRNNSSLFVDLSYDDIQGMYSGLDMLPPGGDFYSSLFASPRVKGTTPRAGAGMGMVPF

SEQ ID NO: 37 - DNA, 1456 bp, Zea mays
  misc_feature (1)..(1456): Ceres Clone ID no. 261978
  misc_feature (1)..(1456): Encodes the peptide sequence at SEQ ID NO. 38
gacaacaccgcgcgcgcaatacacgggacacacacgcagatccgagctaaccaccatcgacgagcgccagccgccagcagccgagccggaccgaccttttcttttttcttttacacagcgggacggagaaaggagtcaatcagccaaagccacccaccgcttttacccaccgatcggcgttgccgccgctagcattgtcggcttcagctccatccaaatccaccgccagcaagcaagcaagcaagccggcgccatgggtctgccgatgaggagggagagggacgcggaggcggagctgaacctgccgccggggttccggttccaccccaccgacgacgagctggtggagcactacctgtgccgcaaggcggcggggcagcgcctccccgtgcccatcatcgccgaggtggacctgtacaggttcgacccctgggacctgccggagcgcgcgctcttcggggcccgcgagtggtacttcttcacgcccagggaccgcaagtaccccaacggctcccgccccaaccgcgccgccggcaacgggtactggaaggccaccggcgccgacaagcccgtcgcgccgcgcggccgcacgctcgggatcaagaaggcgctcgtcttctacgccggcaaggcgccgcgcggggtcaagacggactggatcatgcacgagtacaggctcgccgacgccggccgcgccgccgccgccaagaaggggtcgcttaggttggatgactgggtgctgtgccggctgtacaacaagaagaacgagtgggagaagatgcagctggggaagaccgccgtcgccggcgtcggcgccaccaaggaggaggcgatggacatggccacctcgcacacgcactcccactcccaatcacactcgcactcgtggggcgagacgcgcacgccagagtcggagatcgtggacaacgacccgttcccggagctggactcgttcccggcgttccaggacccggcgatgatgatgacggtgcccaaggaggagcaggtggacggctgcagcgccaagagcggcaacctgttcgtggacctcagctacgacgacatccagggcatgtacagcggcctcgacatgctgccgccgcccggggaggacttctactcctcgctcttcgcgtctcccagggtcaaggggaaccagcccgccggagccgccgggttgggacagttctgagctgaggcgaggatggagccatggatcaggagatgaagacggttgcgaactctgtaaatacagcataggagtcgaacctgaccctgacccttgttggggttacaaggttttccgagtgtcggtgtagcgtacatggagccggcggcgcggccgggccggctcattctttagtttcacttccaaagcagacgggtagatatatgtgtagctgttcacttaaactctcttcgacagaacaaccgacgaaattttgctcttgtttat

SEQ ID NO: 38 - protein, 312 aa, Zea mays
  misc_feature (1)..(312): Ceres Clone ID no. 261978
  misc_feature (17)..(142): Pfam Name: NAM Pfam Description: No apical meristem (NAM) protein
  misc_feature (1)..(312): Bit score of 608.8 for HMM based on sequences of Figure 4
  misc_feature (1)..(312): Functional Homolog Of SEQ ID NO. 2
MGLPMRRERDAEAELNLPPGFRFHPTDDELVEHYLCRKAAGQRLPVPIIAEVDLYRFDPWDLPERALFGAREWYFFTPRDRKYPNGSRPNRAAGNGYWKATGADKPVAPRGRTLGIKKALVFYAGKAPRGVKTDWIMHEYRLADAGRAAAAKKGSLRLDDWVLCRLYNKKNEWEKMQLGKTAVAGVGATKEEAMDMATSHTHSHSQSHSHSWGETRTPESEIVDNDPFPELDSFPAFQDPAMMMTVPKEEQVDGCSAKSGNLFVDLSYDDIQGMYSGLDMLPPPGEDFYSSLFASPRVKGNQPAGAAGLGQF

SEQ ID NO: 39 - DNA, 1434 bp, Panicum virgatum
  misc_feature (1)..(1434): Ceres Clone ID no. 1797688
  misc_feature (1)..(1434): Encodes the peptide sequence at SEQ ID NO. 40
ttcaagaacatcgcggaatccacaggacacagccagagctctctctcaaccaccagcagcagccggagctgaggagagcgttgcggtttcagagtgggagggagaaatcaaggagccagcttgatcaattgcagcttcagctttgccggccgatcagcgatcgccatgggagtgccggtgaggagggagagggacgcggaggcggagctgaacctgccgccggggttccggttccacccgacggacgacgagctggtggagcactacctgtgccggaaggcggcggggcagcgcctcccggtgcccatcatcgcggaggtggacctgtacaagttcgacccctgggacctgccggagcgcgcgctgttcggcacccgggagtggtacttcttcacgcccagggaccgcaagtaccccaacggctcgcgccccaaccgcgccgccgggaacggctactggaaggccaccggcgccgacaagcccgtcgcgccgcgggggcgcacgctggggatcaagaaggcgctcgtgttctacgccggcaaggcgccgcgcggggtcaagaccgactggatcatgcacgagtacaggctggccgacgccggccgcgccgccgcggccaagaagggatcgctcaggctggatgactgggtgctgtgccacctgtacaacaagaagaacgagtgggagaagatgcagctggggaagacggagtccgccgccggcgccgtgcccaaggaggaggctatggacatgaccacctcccactcgcactcgcagtcccactcgcactcgtggggcgagacgcgcacgccggagtcggagatcgtggacaacgaccccttcccggagctggactcgttcccggcgttccaggaccccgcggcggcgatgatggtgcccaagaaggagccgcacgcggacgacggcaacaacaacaacgccgccgccaagaacagcaacctgttcgtggacctcagctacgacgacatccagagcatgtacagcgggctcgacatgctgccgccgcccggggaggacttctactcgtcgctcttcgcgtcgccgagggtcaaggggaaccagcccgcgggcgccgctgggttggccccgttctgagaatctgagctgacgcggcacggcaaccatgtgaggatggtggatgatggccgacgaggagaggagacggcgccccaaggctgcggcggcgacctctgtaaatacagcgtaggagtcgaagaagaacctgaaccacggaacctgatcggggtcgcagggttaagagtgtcggtgtagcgtacatggagccggccccggtgggtggcgccaggctcattcttttgttttcacctttcacctgagacgatagatactcgatcgtatatgtgtagctctttcctcttcaacagaaccgacgaaattttgctgttcctcttt

SEQ ID NO: 40 - protein, 316 aa, Panicum virgatum
  misc_feature (1)..(316): Ceres Clone ID no. 1797688
  misc_feature (17)..(142): Pfam Name: NAM Pfam Description: No apical meristem (NAM) protein
  misc_feature (1)..(316): Bit score of 613.7 for HMM based on sequences of Figure 4
  misc_feature (1)..(316): Functional Homolog Of SEQ ID NO. 2
MGVPVRRERDAEAELNLPPGFRFHPTDDELVEHYLCRKAAGQRLPVPIIAEVDLYKFDPWDLPERALFGTREWYFFTPRDRKYPNGSRPNRAAGNGYWKATGADKPVAPRGRTLGIKKALVFYAGKAPRGVKTDWIMHEYRLADAGRAAAAKKGSLRLDDWVLCHLYNKKNEWEKMQLGKTESAAGAVPKEEAMDMTTSHSHSQSHSHSWGETRTPESEIVDNDPFPELDSFPAFQDPAAAMMVPKKEPHADDGNNNNAAAKNSNLFVDLSYDDIQSMYSGLDMLPPPGEDFYSSLFASPRVKGNQPAGAAGLAPF

SEQ ID NO: 41 - protein, 299 aa, Zea mays
  misc_feature (1)..(299): Public GI ID no. 300510868
  misc_feature (19)..(146): Pfam Name: NAM Pfam Description: No apical meristem (NAM) protein
  misc_feature (1)..(299): Bit score of 562.9 for HMM based on sequences of Figure 4
  misc_feature (1)..(299): Functional Homolog Of SEQ ID NO. 2
MGQPVTRRRERDAEAELDLPPGFRFHPTDNELVEHYLCRKAAGQRLPVPIIAEVDLYRFDPWDLPERALFGTREWYFFTPRDRKYPNGSRPNRAAGDGYWKATGADKPVASRAAARTLGIKKALVFYAGKAPRGVKTDWIMHEYRLADAGRRAKKGSLRLDDWVLCRLYNKKNEWEKMRLGKGAAAGAVKEEEAMDMSTSHSQITHSWGETRTPESEIVDNDLPFPDPAMMVPKKERVDDGGSARTSDLFVDLSYDDIQGMYSGLDMLPPVGEDLYSSLFASPRVRGNQPTGAAGLGPF

SEQ ID NO: 42 - protein, 329 aa, Triticum aestivum
  misc_feature (1)..(329): Public GI ID no. 51702426
  misc_feature (19)..(145): Pfam Name: NAM Pfam Description: No apical meristem (NAM) protein
  misc_feature (1)..(329): Bit score of 589.9 for HMM based on sequences of Figure 4
  misc_feature (1)..(329): Functional Homolog Of SEQ ID NO. 2
MGMPAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRAAASKKGSLRLDDWVLCRLYNKKNEWEKMQLQQQGEEETMMEPKAENTASDMVVTSHSHSQSQSHSHSWGEARTPESEIVDNDPSLFQQATAAAFQAQSPAAAAAHQEMMATLMVPKKEAADEAGRNDLFVDLSYDDIQSMYNGLDMMPPGDDLLYSSLFASPRVRGSQPGAGGMPAPF

SEQ ID NO: 43 - protein, 302 aa, Zea mays
  misc_feature (1)..(302): Public GI ID no. 219884691
  misc_feature (19)..(149): Pfam Name: NAM Pfam Description: No apical meristem (NAM) protein
  misc_feature (1)..(302): Bit score of 556.5 for HMM based on sequences of Figure 4
  misc_feature (1)..(302): Functional Homolog Of SEQ ID NO. 2
MGQPVTRRRERDAEAELDLPPGFRFHPTDDELVEHYLCRKAAGQRLPVPIIAEVDLYRFDPWDLPERALFGAREWYFFTPRDRKYPNGSRPNRAAGDGYWKATGADKPVAPRAAAADARTLGIKKALVFYAGKAPRGVKTDWIMHEYRLADAGRRAKKGSLRLDDWVLCRLYNKKNEWEKMRLGKGAAAGAVKEEEAMDMSTSHSQITHSWGETRTPESEIVDNDLPFPDPAMMVPKKERVDDGGSARTSDLFVDLSYDDIQGMYSGLDMLPPAGEDLYSSLFASPRVRGNQPTGPAGLGPF

SEQ ID NO: 44 - protein, 327 aa, Triticum aestivum
  misc_feature (1)..(327): Public GI ID no. 292659262
  misc_feature (19)..(145): Pfam Name: NAM Pfam Description: No apical meristem (NAM) protein
  misc_feature (1)..(327): Bit score of 566.3 for HMM based on sequences of Figure 4
  misc_feature (1)..(327): Functional Homolog Of SEQ ID NO. 2
MGMPAVRRRERDAEAELNLPPGFRFHPTDDELVEHYLCRKAAGQRLPVPIIAEVDLYRFDPWALPDRALFGTRVWYFFTPRDRKYPNGSRPNRAAGNGYWKATGADKPVAPRGGRTMGIKKALVFYAGKAPKGVKTDWIMHEYRLADAGRAAASKKGSLRLDDCVLCRLYNKKNEWGKMQLQQQGGEEMMVEPKAENTASDMVVTSHSHSQSQSHSHSWGEARTPESEIVDNDPSLFQQAAAFQAQSPAAAAAHQEMMATLMVPKKEAAEEAGRNDLFVDLSYDDIQSMYNGLDMMPPGDDLLYSSLFASPRLRGSQPGAGGMPAPF

SEQ ID NO: 45 - protein, 303 aa, Elaeis guineensis
  misc_feature (1)..(303): Public GI ID no. 82400213
  misc_feature (14)..(141): Pfam Name: NAM Pfam Description: No apical meristem (NAM) protein
  misc_feature (1)..(303): Bit score of 690.2 for HMM based on sequences of Figure 4
  misc_feature (1)..(303): Functional Homolog Of SEQ ID NO. 2
MGSRRRDAEAELNLPPGFRFHPTDEELVVHYLCKKVACQRLPVPIIAEVDLYKYDPWDLPEKALFGLKEWYFFTPRDRKYPNGSRPNRAAGRGYWKATGADKPVTPKGSSRPLGIKKALVFYSGKAPRGVKTDWIMHEYRLADTNRAANKKGSLRLDDWVLYRLYNKKNTWEKMQQQKEAASFGETMDSVDDTGSDSFRTPESDIDNDVMFPDFDDMAQVGAHPPQAFNGMQGVRVNNITGYQPAIEQRPKEENDWFTDLNLDDFHSTCMAFGSTPALDMSDHDYYYSNLPQLRSNQSDLLPF

SEQ ID NO: 46 - DNA, 660 bp, Zea mays
  misc_feature (1)..(660): Ceres Clone ID no. 1566599
  misc_feature (1)..(660): Encodes the peptide sequence at SEQ ID NO. 47
ttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgccctcttcggccgccgcgagtggtacttcttcacgccgcgggaccgcaagtaccccaacggctcccgccccaaccgcgccgccgggtcgggctactggaaggccacgggcgcggacaagcccgtggagcacgggggccggacggcggggatcaagaaggcgctcgtgttctaccacggcaagccgccgcgcggggtcaagacggagtggatcatgcacgagtaccgcctcgccggcgacgcgaagaagtccggcgccggcacgctcaggctggatgactgggtgctgtgccgcctgtacacaagaagaacgagtgggagaagatgcagcagcagaaggagaaggagaagaaggc

SEQ ID NO: 47 - protein, 190 aa, Zea mays
  misc_feature (1)..(190): Ceres Clone ID no. 1566599
  misc_feature (24)..(149): Pfam Name: NAM Pfam Description: No apical meristem (NAM) protein
  misc_feature (1)..(190): Bit score of 310.4 for HMM based on sequences of Figure 4
  misc_feature (1)..(190): Functional Homolog Of SEQ ID NO. 2
MVAMAAVQQQQQQQRRDAEAELNLPPGFRFHPTDEELVAHYLCARAAGRRPPVSIIAEVDLYRFDPWDLPERALFGRREWYFFTPRDRKYPNGSRPNRAAGSGYWKATGADKPVEHGGRTAGIKKALVFYHGKPPRGVKTEWIMHEYRLAGDAKKSGAGTLRLDDWVLCRLYTRRTSGRRCSSRRRRRRR

SEQ ID NO: 48 - protein, 316 aa, Oryza sativa
  misc_feature (1)..(316): Public GI ID no. 6730938
  misc_feature (1)..(316): Oryza sativa Japonica Group
  misc_feature (19)..(146): Pfam Name: NAM Pfam Description: No apical meristem (NAM) protein
  misc_feature (1)..(316): Bit score of 566.2 for HMM based on sequences of Figure 4
  misc_feature (1)..(316): Functional Homolog Of SEQ ID NO. 2
MAAAVGGSGRRDAEAELNLPPGFRFHPTDEELVVHYLCRKVARQPLPVPIIAEVDLYKLDPWDLPEKALFGRKEWYFFTPRDRKYPNGSRPNRAAGRGYWKATGADKPVAPKGSARTVGIKKALVFYSGKAPRGVKTDWIMHEYRLADADRAPGGKKGSQKLDEWVLCRLYNKKNNWEKVKLEQQDVASVAAAAPRNHHHQNGEVMDAAAADTMSDSFQTHDSDIDNASAGLRHGGCGGGGFGDVAPPRNGFVTVKEDNDWFTGLNFDELQPPYMMNLQHMQMQMVNPAAPGHDGGYLQSISSPQMKMWQTILPPF

SEQ ID NO: 49 - protein, 316 aa, Oryza sativa
  misc_feature (1)..(316): Public GI ID no. 125528153
  misc_feature (1)..(316): Oryza sativa Indica Group
  misc_feature (19)..(146): Pfam Name: NAM Pfam Description: No apical meristem (NAM) protein
  misc_feature (1)..(316): Bit score of 565.7 for HMM based on sequences of Figure 4
  misc_feature (1)..(316): Functional Homolog Of SEQ ID NO. 2
MAAAVGGSGRRDAEAELNLPPGFRFHPTDEELVVHYLCRKVARQPLPVPIIAEVDLYKLDPWDLPEKALFGRKEWYFFTPRDRKYPNGSRPNRAAGRGYWKATGADKPVAPKGSARTVGIKKALVFYSGKAPRGVKTDWIMHEYRLADADRAPGGKKGSQKLDEWVLCRLYNKKNNWEKVKLEQQDVASVAAAAPRNHHHQNGEVMDAAAADTMSDSFQTHDSDIDNASAGLRHGGCGGGVFGDVAPPRNGFVTVKEDNDWFTGLNFDELQPPYMMNLQHMQMQMVNPAAPGHDGGYLQSISSPQMKMWQTILPPF

SEQ ID NO: 50 - protein, 369 aa, Eleusine coracana
  misc_feature (1)..(369): Public GI ID no. 185179439
  misc_feature (24)..(149): Pfam Name: NAM Pfam Description: No apical meristem (NAM) protein
  misc_feature (1)..(369): Bit score of 490.3 for HMM based on sequences of Figure 4
  misc_feature (1)..(369): Functional Homolog Of SEQ ID NO. 2
MTMGGGMMSVPVRRERDAEAELNLPPGFRFHPTDDELVEHYLCRKAAGQRLPVPIIAEVDLYKFDPWDLPDRALFGTGEWYFFTPRDRKYPNGSRPNRAAGNGYWKATGADKPVAPKGRTLGIKKALVFYAGKAPRGVKTDWIMHEYRLADAGRAAAAKKGSLRLDDWVLCRLYNKKNEWEKMQMKKGYRRRHCHCKGGGSRRRHDHLLELALALVGRDPHAGVGDRGQRPVPGARLVPGVPGPGTAAASAADDGAQERRGWTTPPPPARHPSLHRPPAMTTSRACTSGLDMLPPPGGGLLLLALRVAQGQGEPDRPASVAWPPSEVMLSGARWCCWNHHHQSSRRDRPSDERQDGGGGDFAGLQLRPL

SEQ ID NO: 51 - DNA, 731 bp, Panicum virgatum
  misc_feature (1)..(731): Ceres Clone ID no. 1810747
  misc_feature (1)..(731): Encodes the peptide sequence at SEQ ID NO. 52
aaagaacatcgacgaatccacaggacacagccagagctcgctctcaaccagcagcagcagccggagctgaggagagcgttgcggtttcagagtgggagggagaaatcaaggagccagcttcagtctgccgatcaattgcagcttcatcttcgccggccgatcagcgatcgccatgggagtgccggtgaggagggagagggacgcggaggcggagctgaacctcccgccggggttccggttccacccgacggacgacgagctggtggagcactacctgtgccggaaggcggcggggcagcgcctcccggtgcccatcatcgcggaggtggacctgtacaagttcgacccctgggacctgccggagcgcgcgctgttcggcacccgggagtggtacttcttcacgcccagggaccgcaagtaccccaacggctcgcgccccaaccgcgccgccgggaacggctactggaaggccaccggcaccgacaagcccgtcgctccgcgggggcgcacgctggggatcaagaaggcgctcgtgttctacgccggcaaggcgccgcgcgggatcaagaccgactggatcatgcacgagtacaggctcgccgacgccggccgcgccgccgcagccaagaaggggtcgctcaggttggatgactgggtgctgtgccgcctgtacaacaagaagaacgagtgggagaagatgcagctggggaaggagtccgccgcccggcgcg

SEQ ID NO: 52 - protein, 186 aa, Panicum virgatum
  misc_feature (1)..(186): Ceres Clone ID no. 1810747
  misc_feature (17)..(142): Pfam Name: NAM Pfam Description: No apical meristem (NAM) protein
  misc_feature (1)..(186): Bit score of 375.3 for HMM based on sequences of Figure 4
  misc_feature (1)..(186): Functional Homolog Of SEQ ID NO. 2
MGVPVRRERDAEAELNLPPGFRFHPTDDELVEHYLCRKAAGQRLPVPIIAEVDLYKFDPWDLPERALFGTREWYFFTPRDRKYPNGSRPNRAAGNGYWKATGTDKPVAPRGRTLGIKKALVFYAGKAPRGIKTDWIMHEYRLADAGRAAAAKKGSLRLDDWVLCRLYNKKNEWEKMQLGKESAARR

SEQ ID NO: 53 - DNA, 1261 bp, Triticum aestivum
  misc_feature (1)..(1261): Ceres Clone ID no. 736293
  misc_feature (1)..(1261): Encodes the peptide sequence at SEQ ID NO. 54
acttacttggtcgccaaggaaacgagccatcaacaaaagagaaggctccaggtcccaggaggcggtatcacaacctgcagccgcctttctcttctcttcttcttctcttccagcaccgggcgggcgcggccggggttttcttttctccaaggtggtggagcgggcgagcgaacgcgaggagggggaggatgatgacggcaatggtgaaggccgagccgacggcggcggaggggagcagcgggcggagggacgcggaggcggagctcaacctgccgccgggcttccgcttccaccccacggacgacgagctcgtcgtgcactacctctgcaggaaggtggcgggccagccgcagcccgtgcccatcatcgccgaggtcgatctctacaagttcaacccctgggatctgcccgagagggcgctgttcgggagcagggagtggtacttcttcacgccacgcgaccgcaagtaccccaacggctcgcgccccaaccgctccgccggcaccggctactggaaggccaccggcgccgacaagcccgtggcgcccaaggagagcggcggcaggacggtcggcatcaagaaggcgctcgtcttctactccggcagggcgcccaggggcgtcaagaccgactggatcatgcacgagtaccgcatcgccgaagccgaccgcgcacccggcaagaagggatccctcaagctggacgaatgggtgctgtgccggctgtacaacaagaagaacaactgggagaaggtcaaggtggagcaggacatggctgtggaggccgggccaaacggggaggtcatggacgcgctggcgaccgacgccatatccgacagcttccagacgcacgactcctcggagatcgacagcgcctccggcctgcagcagcgcgtcttcacggacatggcgcaggggcagccgagaggcggcatggtgacggtgaaggaggacagcgactggttcaccggcctgagcatggacgacctgcagacttgctatatgaacatggggcagatggtgaacccggcgacgatgcctgggcaggacggcagcggctacctacagtcgatgagctcaccgcagatgatgaggccgatgtggcaaacaatcttgccaccattctgagatggaaccagaaagatatggtgtaaattattggaaatagaagtgattagacaaatatacttactttgttgaactagaaagagatagagatttcccaggcatgattctgaagatgtggtggtaggcttgtagcg

SEQ ID NO: 54 - protein, 308 aa, Triticum aestivum
  misc_feature (1)..(308): Ceres Clone ID no. 736293
  misc_feature (24)..(152): Pfam Name: NAM Pfam Description: No apical meristem (NAM) protein
  misc_feature (1)..(308): Bit score of 625.8 for HMM based on sequences of Figure 4
  misc_feature (1)..(308): Functional Homolog Of SEQ ID NO. 2
MVKAEPTAAEGSSGRRDAEAELNLPPGFRFHPTDDELVVHYLCRKVAGQPQPVPIIAEVDLYKFNPWDLPERALFGSREWYFFTPRDRKYPNGSRPNRSAGTGYWKATGADKPVAPKESGGRTVGIKKALVFYSGRAPRGVKTDWIMHEYRIAEADRAPGKKGSLKLDEWVLCRLYNKKNNWEKVKVEQDMAVEAGPNGEVMDALATDAISDSFQTHDSSEIDSASGLQQRVFTDMAQGQPRGGMVTVKEDSDWFTGLSMDDLQTCYMNMGQMVNPATMPGQDGSGYLQSMSSPQMMRPMWQTILPPF

SEQ ID NO: 55 - protein, 314 aa, Triticum aestivum
  misc_feature (1)..(314): Public GI ID no. 292659260
  misc_feature (32)..(160): Pfam Name: NAM Pfam Description: No apical meristem (NAM) protein
  misc_feature (1)..(314): Bit score of 630.1 for HMM based on sequences of Figure 4
  misc_feature (1)..(314): Functional Homolog Of SEQ ID NO. 2
MMTAMVKAEPTGAAAGAEGSSGRRDAEAELNLPPGFRFHPTDDELVVHYLCRKVAGQPQPVPIIAEVDLYKFNPWDLPERALFGSREWYFFTPRDRKYPNGSRPNRSAGTGYWKATGADKPVAPRESGGRTVGIKKALVFYSGRAPRGVKTDWIMHEYRIAEADRAPGKKGSLKLDEWVLCRLYNKKNNWEKLKVEQDMAVEAGPNGEVMDALATDAMSDSFQTHDSSEIDSASGLQQHGFMDMAQQQARMVTVKEDSDWFTGLSMDDLQTCYMNMGQMVNPTTMPGQNGSGYLQPMSSPQMMRPMWQTILPPF

SEQ ID NO: 56 - protein, 316 aa, Sorghum bicolor
  misc_feature (1)..(316): Public GI ID no. 242059063
  misc_feature (22)..(149): Pfam Name: NAM Pfam Description: No apical meristem (NAM) protein
  misc_feature (1)..(316): Bit score of 581.3 for HMM based on sequences of Figure 4
  misc_feature (1)..(316): Functional Homolog Of SEQ ID NO. 2
MAMVAAAAEGSGRRDAEAELNLPPGFRFHPTDEELVVYYLCRKVARQQLPVPIIAEVDLYKFDPWDLPEKALFGRKEWYFFTPRDRKYPNGSRPNRAAGRGYWKATGADKPIAPKGSGRAAGIKKALVFYSGKAPRGIKTDWIMHEYRLADADRAPGKKGSQKLDEWVLCRLYNKKNNWEKVKVEPEPEAAAHHNRQSAAEDSMSDSFQTHDSDIDNASGMQQQQQQQQSFFGDMVQGQAMNMRNNGIGTVTVKEDNDWFTDLNLDDLQASYNMAHMVNPNPVVQTVNLVAGQGHGYLQSMSSPSMKMWQTILPPF

SEQ ID NO: 57 - protein, 335 aa, Elaeis guineensis
  misc_feature (1)..(335): Public GI ID no. 82400209
  misc_feature (14)..(141): Pfam Name: NAM Pfam Description: No apical meristem (NAM) protein
  misc_feature (1)..(335): Bit score of 656.3 for HMM based on sequences of Figure 4
  misc_feature (1)..(335): Functional Homolog Of SEQ ID NO. 2
MGSRRRDAEAELNLPPGFRFHPTDEELVVHYLCKKVACQRLPVPIIAEVDLYKYDPWDLPEKALFGLKEWYFFTPRDRKYPNGSRPNRAAGRGYWKATGADKPVTPKGSSRPLGIKKALVFYSGKAPRGVKTDWIMHEYRLADTNRAANKKGSLRVCHRQSEIHKFFGFLGFFMNIDSDEKIHEFMQLDDWVLCRLYNKKNTWEKMQQQKEAASFGETMDSVDDTGSDSFRTPESDIDNDVMFPDFDDMAQVGAHPPQAFNGMQGVRVNNITGYQPAIEQRPKEENDWFTDLNLDDFHSTCMAFGSTPALDMSDHDYYYSNLPQLRSNQSDLLPF

SEQ ID NO: 58 - protein, 186 aa, Zea mays
  misc_feature (1)..(186): Public GI ID no. 223975401
  misc_feature (22)..(147): Pfam Name: NAM Pfam Description: No apical meristem (NAM) protein
  misc_feature (1)..(186): Bit score of 275.7 for HMM based on sequences of Figure 4
  misc_feature (1)..(186): Functional Homolog Of SEQ ID NO. 2
MVMAPAAAQQQRRRDAEAELNLPPGFRFHPTDEELVAHYLCARAAGRRPPVSIIAEVDLYRFDPWDLPERALFGRREWYFFTPRDRKYPNGSRPNRAAGSGYWKATGADKPVEHGGRTVGVKKALVFYHGKPPRGVKTEWIMHEYRLADAGARARARKPGTGTLRVSGEHLAVSRRIFFLGFISSL

SEQ ID NO: 59 - protein, 278 aa, Hordeum vulgare
  misc_feature (1)..(278): Public GI ID no. 138753440
  misc_feature (1)..(278): Hordeum vulgare subsp. vulgare
  misc_feature (26)..(154): Pfam Name: NAM Pfam Description: No apical meristem (NAM) protein
  misc_feature (1)..(278): Bit score of 534.3 for HMM based on sequences of Figure 4
  misc_feature (1)..(278): Functional Homolog Of SEQ ID NO. 2
MVKAEAMTAEAEGSSGRRDAEAELNLPPGFRFHPTDDELVVHYLCRKVAGQPQPVPIIAEVDLYKFNPWDLPERALFGSREWYFFTPRDRKYPNGSRPNRSAGTGYWKATGADKPVAPRESGGRTVGIKKALVFYSGRAPRGVKTDWIMHEYRIAQADRTPGKKGSLKLDEWVLCRLYNKKNNWDKVKVEQDMAVVQGQNGEVMDALATDAMSDSFQTHDSSEIDNASGLQQQHHGFMDMAQRQAREGMVTVKEDSDWFTRPEYGRPADLLHEPWGRW

SEQ ID NO: 60 - DNA, 653 bp, Zea mays
  misc_feature (1)..(653): Ceres Clone ID no. 101131915
  misc_feature (1)..(653): Encodes the peptide sequence at SEQ ID NO. 61
agcagtcttccgcgggagcgagctgttgacaccgagtcggagtcggacggaggactggcaggcacaaccgaagccaccgcttctagttctcgggttcatcgccagcaatccagaccacataatgggactgccggtgacgaggaggagggagagggacgcggaggcggagctggacctgccgccggggttccggttccaccccaccgacgacgagctggtggagcactacctgtgccgcaaggcggcggggcagcgcctccccgtgcccatcatcgccgaggtggacctgtacaggttcgacccctgggacctgccggagcgcgcgctcttcggggcccgggagtggtacttcttcacgcccagggaccgcaagtaccccaacggctcccgccccaaccgcgccgccggcgacgggtactggaaggccaccggcgccgacaagcccgtcgcgccgcgcgccgccgacgcccgcacgctcgggatcaagaaggcgctcgtcttctacgccgggaaggcgccgcgcggggtcaagacggactggatcatgcacgagtacaggctcgccgacgccagtggccgcgccaagaaggggtcgctcaagttggatgactgggtgctgtgccggctgtacaacaagaagaacgagtgggaga

SEQ ID NO: 61 - protein, 177 aa, Zea mays
  misc_feature (1)..(177): Ceres Clone ID no. 101131915
  misc_feature (19)..(147): Pfam Name: NAM Pfam Description: No apical meristem (NAM) protein
  misc_feature (1)..(177): Bit score of 320.5 for HMM based on sequences of Figure 4
  misc_feature (1)..(177): Functional Homolog Of SEQ ID NO. 2
MGLPVTRRRERDAEAELDLPPGFRFHPTDDELVEHYLCRKAAGQRLPVPIIAEVDLYRFDPWDLPERALFGAREWYFFTPRDRKYPNGSRPNRAAGDGYWKATGADKPVAPRAADARTLGIKKALVFYAGKAPRGVKTDWIMHEYRLADASGRAKKGSLKLDDWVLCRLYNKKNEWE

SEQ ID NO: 62 - DNA, 691 bp, Zea mays
  misc_feature (1)..(691): Ceres Clone ID no. 100821085
  misc_feature (1)..(691): Encodes the peptide sequence at SEQ ID NO. 63
gacaacgcgattctatttatttatctggctgccagccagccagccgcctttcgaaaccgagcacgagggagccgacgtggtggtctctggaacctggttcgagcgagcgagcgacccatctatccagccgcctgccgggaatttctgtgacgacgacgaggaggaggagggggtatggcaatggtggcggcgcagggaggcggccggagggacgccgaggcggagctcaacctgccgccggggttccggttccatcccaccgatgaggagctggtggtgcactacctctgcaggaaggtggcgtgtcagcagctgcccgtgcccatcatcgccgaggtcgacctttacaaattcgacccgtgggatcttccagagaaggcgctgtttggccgcaaggagtggtacttcttcacgccgcgggaccgcaagtacccaaacggctcgcgccccaaccgcgccgccgggagggggtattggaaggcaacgggcgcggacaagccgatcgcgcccaagggcggtggcggggcggcaggaatcaagaaggctctcgtcttctactccggcaaggcgcccaggggattcaagaccgactggatcatgcatgagtaccgcctcgcggacgcggaccgtgcgccgggcaagaagggctcacggaagttggatgagtgggtgttgtgccggctgtacaaca

SEQ ID NO: 63 - protein, 172 aa, Zea mays
  misc_feature (1)..(172): Ceres Clone ID no. 100821085
  misc_feature (20)..(147): Pfam Name: NAM Pfam Description: No apical meristem (NAM) protein
  misc_feature (1)..(172): Bit score of 306.5 for HMM based on sequences of Figure 4
  misc_feature (1)..(172): Functional Homolog Of SEQ ID NO. 2
MAMVAAQGGGRRDAEAELNLPPGFRFHPTDEELVVHYLCRKVACQQLPVPIIAEVDLYKFDPWDLPEKALFGRKEWYFFTPRDRKYPNGSRPNRAAGRGYWKATGADKPIAPKGGGGAAGIKKALVFYSGKAPRGFKTDWIMHEYRLADADRAPGKKGSRKLDEWVLCRLYN

SEQ ID NO: 64 - protein, 306 aa, Malus x domestica
  misc_feature (1)..(306): Public GI ID no. 302399001
  misc_feature (18)..(142): Pfam Name: NAM Pfam Description: No apical meristem (NAM) protein
  misc_feature (1)..(306): Bit score of 652.9 for HMM based on sequences of Figure 4
  misc_feature (1)..(306): Functional Homolog Of SEQ ID NO. 2
MERVQTTPIEMSSADLQLPPGFRFHPTDEELVRHYLCRKCASQPISVPIIAEIDLYKYDPWELPGLALYGEKEWYFFSPRDRKYPNGSRPNRAAGSGYWKATGADKPIGHPKPVGIKKALVFYAGKAPRGEKTNWIMHEYRLADVDRSPRKKNSLRLDDWVLCRIYNKKGTVENQQPQQQQEQQRTTSRNASSGSEFEDRKPDNLRCPPPPASVVPSRHVSDYVYFDNSDSVPKLHTDSSCSEQVVSPELACEVQSEPKWKEWEKALEMPYSYMDTTVENGFGAQFQSGNEMSPLQDIFMYLQKPY

SEQ ID NO: 65 - protein, 299 aa, Vitis vinifera
  misc_feature (1)..(299): Public GI ID no. 225459603
  misc_feature (7)..(131): Pfam Name: NAM Pfam Description: No apical meristem (NAM) protein
  misc_feature (1)..(299): Bit score of 627.2 for HMM based on sequences of Figure 4
  misc_feature (1)..(299): Functional Homolog Of SEQ ID NO. 2
MTAELQLPPGFRFHPTDEELVMHYLCRKCASQSIAVPIIAEIDLYKFDPWQLPEMALYGEKEWYFFSPRDRKYPNGSRPNRAAGTGYWKATGADKPIGHPKPVGIKKALVFYAGKAPRGEKTNWIMHEYRLADVDRSARKKNNSLRLDDWVLCRIYNKKGIVEKQHTAARKSDCSDVEDQKPGPLALSRKVGAMPPPPPPSSSTAPTATAALDDLVYFDSSDSVPRLHTDSSCSEHVVSPEFTCEREVQSEPKWKEWENPMDFSYNYMDATVDNAFLSQFPNNQMSPLQDMFMYLQKPF

SEQ ID NO: 66 - protein, 263 aa, Vitis vinifera
  misc_feature (1)..(263): Public GI ID no. 302141792
  misc_feature (7)..(131): Pfam Name: NAM Pfam Description: No apical meristem (NAM) protein
  misc_feature (1)..(263): Bit score of 541.0 for HMM based on sequences of Figure 4
  misc_feature (1)..(263): Functional Homolog Of SEQ ID NO. 2
MTAELQLPPGFRFHPTDEELVMHYLCRKCASQSIAVPIIAEIDLYKFDPWQLPEMALYGEKEWYFFSPRDRKYPNGSRPNRAAGTGYWKATGADKPIGHPKPVGIKKALVFYAGKAPRGEKTNWIMHEYRLADVDRSARKKNNSLRLDDWVLCRIYNKKGIVEKQHTAARKSDCSDVGAMPPPPPPSSSTAPTATAALDDLVYFDSSDSREVQSEPKWKEWENPMDFSYNYMDATVDNAFLSQFPNNQMSPLQDMFMYLQKPF

SEQ ID NO: 67 - protein, 289 aa, Oryza sativa
  misc_feature (1)..(289): Public GI ID no. 125572421
  misc_feature (1)..(289): Oryza sativa Japonica Group
  misc_feature (19)..(140): Pfam Name: NAM Pfam Description: No apical meristem (NAM) protein
  misc_feature (1)..(289): Bit score of 456.8 for HMM based on sequences of Figure 4
  misc_feature (1)..(289): Functional Homolog Of SEQ ID NO. 2
MAAAVGGSGRRDAEAELNLPPGFRFHPTDEELVVHYLCRKVARQPLPVPIIAEVDLYKLDPWDLPEKALFGRKEWYFFTPRDRKYPNGSRPNRAAGRGYWKATGADKPVAPKGSARTVGIKKALVFYSGKAPRGLDEWVLCRLYNKKNNWEKVKLEQQDVASVAAAAPRNHHHQNGEVMDAAAADTMSDSFQTHDSDIDNASAGLRHGGCGGGGFGDVAPPRNGFVTVKEDNDWFTGLNFDELQPPYMMNLQHMQMQMVNPAAPGHDGGYLQSISSPQMKMWQTILPPF

SEQ ID NO: 68 - DNA, 1397 bp, Glycine max
  misc_feature (1)..(1397): Ceres Clone ID no. 542522
  misc_feature (1)..(1397): Encodes the peptide sequence at SEQ ID NO. 69
acgtttcaaatcgcagtctcagagcaaagcagagccaagaagaagaagaagaaaaccaacataatcaacaacaacaacaacaaaaagcttgcaaattagaagaatcttcagttaaaagggaagaagaacacacaagaagaaagagaagaagaaacgcgcgcgaatgaagggagaattagagttgccacctgggttcagatttcaccccactgatgaagaattggtgaatcactacttgtgtaggaagtgcgctggtcaaccaatcgcggttcccgtcatcaaagaggtcgatttgtacaagtttgatccatggcagcttccagaaattggtttttacggcgagaaagaatggtacttcttttctcctcgggaccggaaatacccgaacggttcacggccgaaccgcgccgccggaagcggctattggaaagccaccggcgctgataaaccgatcggaaaaccgaaagcgcttgggatcaagaaagctctggttttttacgccggaaaagcccccaaaggtgtgaaaaccaattggattatgcacgaatatcgcctcgccaatgttgaccgatctgcctccaagaaaaaaaacaacaacttgaggcttgatgattgggtgttgtgtcgaatctacaacaagaaagggaagattgagaaatacaacacaggcgcagcgaagatgaatgttgagatggttcatagttttgagcacgagaacgagacgaagccagagattcataagctaggaaatgagcaattgtacatggagacttcggattcggtgccaaggttgaacacggactcgagcagttcggagcacgtggtttcgcccgatgtcacgtgcgagagggaggtgcagagcgaccccaagtggaacgatgatctggacctaaagctagaaaacgcgtttgattttcagtttaattacttggacgataataacctttccgtggatgattacctttttggcactgttcagtatcaaatgggccagctctcgcccttgcaggacatgttcatgtacctacagaagatgtgaaaactgaaaacgaaacgttttgagcaacatgggacccgcaaatatctttgttttattatttttttaaaaggaaaagtcagcatttgtatgcaattgcattgcacctaacatgtgatgtgggctaggccaagcttagcaactattcttattctttgttctagagagatgagggaatgttgaattcggctgaaatgggctatttggattggttcttggtgtaaagaaaaaatgagagaaggagattaggtgctgcagtaagtaaaaagtaagtgagcaaattgatgataggttattggagggttaatgtgtgggtgtaaggactcacttaggaaaattcttgttccattgctattccagc

SEQ ID NO: 69 - protein, 291 aa, Glycine max
  misc_feature (1)..(291): Ceres Clone ID no. 542522
  misc_feature (7)..(131): Pfam Name: NAM Pfam Description: No apical meristem (NAM) protein
  misc_feature (1)..(291): Bit score of 518.7 for HMM based on sequences of Figure 4
  misc_feature (1)..(291): Functional Homolog Of SEQ ID NO. 2
MKGELELPPGFRFHPTDEELVNHYLCRKCAGQPIAVPVIKEVDLYKFDPWQLPEIGFYGEKEWYFFSPRDRKYPNGSRPNRAAGSGYWKATGADKPIGKPKALGIKKALVFYAGKAPKGVKTNWIMHEYRLANVDRSASKKKNNNLRLDDWVLCRIYNKKGKIEKYNTGAAKMNVEMVHSFEHENETKPEIHKLGNEQLYMETSDSVPRLNTDSSSSEHVVSPDVTCEREVQSDPKWNDDLDLKLENAFDFQFNYLDDNNLSVDDYLFGTVQYQMGQLSPLQDMFMYLQKM

SEQ ID NO: 70 - protein, 296 aa, Solanum lycopersicum
  misc_feature (1)..(296): Public GI ID no. 195549547
  misc_feature (8)..(132): Pfam Name: NAM Pfam Description: No apical meristem (NAM) protein
  misc_feature (1)..(296): Bit score of 613.6 for HMM based on sequences of Figure 4
  misc_feature (1)..(296): Functional Homolog Of SEQ ID NO. 2
MTAAELQLPPGFRFHPTDEELVTHYLCRKCTSQPIAVPIVAEIDLYKFDPWDLPDLALYGEKEWYFFSPRDRKYPNGSRPNRAAGTGYWKATGADKPIGNPKAVGIKKALVFYSGKAPKGEKTNWIMHEYRLADVDRSARKNNNSLRLDDWVLCRIYNKKGSIEKNRKMNTTCYMDKVGSPEDRKPEILPPLPPHPQPQQLHNDFFYLPSDSVPKMHSDSSCSEHVLSPEFTCEREVQSEPKLTDWEKATLDLPFNYMDATTGATTVDNSLLGSQFQSSYQMSPLQDMFMHLHKPF

SEQ ID NO: 71 - DNA, 1253 bp, Zea mays
  misc_feature (1)..(1253): Ceres Clone ID no. 100961037
  misc_feature (1)..(1253): Encodes the peptide sequence at SEQ ID NO. 72
tccagaccacataatgggacagccggtgacgaggaggagggagagggacgcggaggcggagctggacctgccgccggggttccggttccaccccacagacgacgagctggtggagcactacctgtgccgcaaggcggcggggcagcgcctccccgtgcccatcatcgccgaggtggacctgtacaggttcgacccgtgggacctgccggagcgcgcgctcttcggggcccgggagtggtacttcttcacgcccagggaccgcaagtaccccaacggctcccgccccaaccgcgccgccggcgacgggtactggaaggccaccggcgccgacaagcccgtcgcgccgcgcgccgccgccgccgacgcccgcacgctcgggatcaagaaggcgctcgtcttctacgccggcaaggcgccgcgcggggtcaagacagactggatcatgcacgagtacaggctcgctgacgccggccgccgcgccaagaaggggtcgctcagggtaagtttctacacacaaaaaaaagagagggctgaacgaggaattttttagcttttaattctgtcttggatcgatctgtgtgtgtgcagttggatgactgggtgctgtgccggctgtacaacaagaagaacgagtgggagaagatgcggctggggaagggggcagccgccggcgcagtcaaagaggaggaggccatggacatgagcacctcccactcgcagatcacccactcgtggggcgagacgcgcacgccggagtcggagatcgtggacaacgacctgccgttcccggatccggcgatgatggtgcccaagaaggagcgggtggacgacggcggcagcgccaggaccagcgacctgttcgtggatttcagttacgacgacatccaaggcatgtacagcggcctcgacatgctgccgccggccggcgaggacttgtactcctcgctcttcgcgtcgcccagggtcagggggaaccagcccaccggacccgcggggttgggccccttctgagtgagctcaggcgaggatggaggcatggagatcaggagagaagacggacggcgttgccaactctgtaaatacagcataggacgaggagtcgaacctgactgaacctggtcggggttacaagtcgagtgtgtcggtgtttcgtacatgggaaccgggccttacatgggagccggcccggtcttggtttggcgctggctcattctttagtttcacttcctgcgcagacggtagatgtgtatgca

SEQ ID NO: 72 - protein, 178 aa, Zea mays
  misc_feature (1)..(178): Ceres Clone ID no. 100961037
  misc_feature (19)..(149): Pfam Name: NAM Pfam Description: No apical meristem (NAM) protein
  misc_feature (1)..(178): Bit score of 268.0 for HMM based on sequences of Figure 4
  misc_feature (1)..(178): Functional Homolog Of SEQ ID NO. 2
MGQPVTRRRERDAEAELDLPPGFRFHPTDDELVEHYLCRKAAGQRLPVPIIAEVDLYRFDPWDLPERALFGAREWYFFTPRDRKYPNGSRPNRAAGDGYWKATGADKPVAPRAAAADARTLGIKKALVFYAGKAPRGVKTDWIMHEYRLADAGRRAKKGSLRVSFYTQKKERAERGIF

SEQ ID NO: 73 - protein, 295 aa, Glycine max
  misc_feature (1)..(295): Public GI ID no. 255640977
  misc_feature (7)..(131): Pfam Name: NAM Pfam Description: No apical meristem (NAM) protein
  misc_feature (1)..(295): Bit score of 498.0 for HMM based on sequences of Figure 4
  misc_feature (1)..(295): Functional Homolog Of SEQ ID NO. 2
MKGELELPPGFRFHPTDEELVNHYLCRKCAGQPIAVPIIKEVDLYKFDPWQLPEIGYYGEKEWYFFSPRDRKYPNGSRPNRAAGSGYWKATGADKAIGKPKALGIKKALVFYAGKAPKGVKTNWIMHEYRLANVDRSASKKNNNNLRLDDWVLCRIYNKKGKIEKYNTTAPKMNLEMIHSFEHENETKPEIHKLGNEQLLYTETSDSVPRLHTDSSSSEHVVSPDVRYEREVQSDPKWNSDDYDLGLQLENAFDFQFNYLDDNNLSVDDDPFGTVQYQMGQLSPLQDVFMYLQKM

SEQ ID NO: 74 - DNA, 1451 bp, Gossypium hirsutum
  misc_feature (1)..(1451): Ceres Clone ID no. 1850651
  misc_feature (1)..(1451): Encodes the peptide sequence at SEQ ID NO. 75
ttttcaagagccgtcaccgcgtagaataccaaagaagtttgtagaaaaaaacaccgagagcgagtgtgaaaaagctcaaaaactagtttattaccttcaaggtgaaaagttcaaaaaatgacagcatcggagttacagctgccacctggattccgattccatccaaccgacgaagagcttgtgatgcactatctttgccggaaatgtgcatcgcagtccatcgctgtgccgattatcgctgaaatcgatctttacaaatacgatccttgggaccttccagatttggcgttgtacggagagaaagaatggtattttttctccccgagggataggaaatatccgaacggttcacggcctaaccgggcagctggttctgggtactggaaggcaaccggagctgacaaaccgattgggcagccgaagccggtcgggattaagaaggctttggtgttttacgctgggaaggcacctaaaggagagaaaaccaattggattatgcacgagtatcggttagctgacgtggaccgatcggctcgcaagaagaacagtttaaggttggacgattgggtgctttgccggatttataacaagaaaggcgccatcgagaaacagtcaccgcaaggaagcattggcaaaagctctgccgtgacggagatcgaagacaagaagccggatatagcgacacttggcgtggacacgcgccagctgcccccgcctcctacggggctaggtaacgattacgtgtactttgacacgtcggagtcggtgccgagactccacacggactcaagctgttcggagcacgtggtgtcaccggagttcacgtgcgaggttcaaagcgagccgcaatggaaggactggggaagtgctaccaacaccaccaccaccaatgcccttgacttcccttataattacatggatgccactgttgataacgggtttcctgcccatttccagagtaataatcagctgtccccgctccaggacatgttcatgtacctgcagaagccattttagaggggaaaaaaatgaaataaaaaggggtatattgttggaagtcaaaacgatgatggtgagctgcgtttcagggttacaggagactgaaagtcaatgagtgtaactgagaagggttgcgcatagattaaataacgaattgaaaaattgaaattgataatattgcagatgggaatggatggcggtggaagtaggatcttatgcaatctagaaaagtagagattagaataggcatgtgtacagataatctgtgatcacgtgtttaggggtttatgttcatgataaatgggtggggggaagaaaagttaaaaaaacaaagttttgggagggtctttttactttgaaggctttccaattattcttgtattttgtagcagaaaaaagattccataatttctttcaaaattcttagtaataatttatgttatttgagatag

SEQ ID NO: 75 - protein, 299 aa, Gossypium hirsutum
  misc_feature (1)..(299): Ceres Clone ID no. 1850651
  misc_feature (8)..(132): Pfam Name: NAM Pfam Description: No apical meristem (NAM) protein
  misc_feature (1)..(299): Bit score of 609.1 for HMM based on sequences of Figure 4
  misc_feature (1)..(299): Functional Homolog Of SEQ ID NO. 2
MTASELQLPPGFRFHPTDEELVMHYLCRKCASQSIAVPIIAEIDLYKYDPWDLPDLALYGEKEWYFFSPRDRKYPNGSRPNRAAGSGYWKATGADKPIGQPKPVGIKKALVFYAGKAPKGEKTNWIMHEYRLADVDRSARKKNSLRLDDWVLCRIYNKKGAIEKQSPQGSIGKSSAVTEIEDKKPDIATLGVDTRQLPPPPTGLGNDYVYFDTSESVPRLHTDSSCSEHVVSPEFTCEVQSEPQWKDWGSATNTTTTNALDFPYNYMDATVDNGFPAHFQSNNQLSPLQDMFMYLQKPF

SEQ ID NO: 76 - DNA, 906 bp, Solanum lycopersicum
  misc_feature (1)..(906): Ceres Annot ID no. 8462230
  misc_feature (1)..(906): Encodes the peptide sequence at SEQ ID NO. 77
atgaacaaaggagcaaacggaaatcagcaattggagttaccggcgggattcagattccatccgacagacgacgaattggtgcagcactatctctgcaggaaatgcgccggacagtcgattgctgtatcaattatagctgaaattgatctttacaagtttgatccatggcagttgcctgagaaggctttgtacggtgaaaaagagtggtattttttctcaccaagggatagaaaatatccgaacggttcacggccgaaccgagcagcaggaaccggttattggaaggcaaccggagctgataaaccggtgggaaaacccaaaaccttagggataaagaaggcacttgtgttctatgccggaaaagcacccagaggtataaaaacaaattggattatgcacgagtaccgcctcgccaacgtggaccgctctgctggcaagaacaataacttgaggcttgatgattgggtattgtgtcgaatatacaacaagaaaggcacacttgagaagcattacaatgtggacaacaaggaaactacaagctttggagaatttgatgaagaaataaaaccaaaaatattgcccacacaattagcaccgatgccaccacggcctcgatcgacaccagcaaacgactacttttatttcgagtcatcagagtcgatgactagaatgcacacgacaaactcgagctctggctcagagcatgtcttgtcgccatgtgacaaggaggttcagagcgcgcccaaatgggacgaagaccacagaaacacccttgattttcagctaaactatttggatggtttactaaatgaaccatttgaaacccaaatgcagcagcaaatttgcaactttgaccagttcaacaatttccaagacatgttcctatacatgcaaaaaccttactaa

SEQ ID NO: 77 - protein, 301 aa, Solanum lycopersicum
  misc_feature (1)..(301): Ceres Annot ID no. 8462230
  misc_feature (13)..(137): Pfam Name: NAM Pfam Description: No apical meristem (NAM) protein
  misc_feature (1)..(301): Bit score of 540.5 for HMM based on sequences of Figure 4
  misc_feature (1)..(301): Functional Homolog Of SEQ ID NO. 2
MNKGANGNQQLELPAGFRFHPTDDELVQHYLCRKCAGQSIAVSIIAEIDLYKFDPWQLPEKALYGEKEWYFFSPRDRKYPNGSRPNRAAGTGYWKATGADKPVGKPKTLGIKKALVFYAGKAPRGIKTNWIMHEYRLANVDRSAGKNNNLRLDDWVLCRIYNKKGTLEKHYNVDNKETTSFGEFDEEIKPKILPTQLAPMPPRPRSTPANDYFYFESSESMTRMHTTNSSSGSEHVLSPCDKEVQSAPKWDEDHRNTLDFQLNYLDGLLNEPFETQMQQQICNFDQFNNFQDMFLYMQKPY

SEQ ID NO: 78 - protein, 291 aa, Camellia sinensis
  misc_feature (1)..(291): Public GI ID no. 198400323
  misc_feature (7)..(131): Pfam Name: NAM Pfam Description: No apical meristem (NAM) protein
  misc_feature (1)..(291): Bit score of 582.4 for HMM based on sequences of Figure 4
  misc_feature (1)..(291): Functional Homolog Of SEQ ID NO. 2
MASELQMPPGFRFHPTDEELVMHYLCRKCASQSIAVPIIAEIDLYKYDPWELPGLALYGEKEWYFFSPRDRKYPNGSRPNRAAGSGYWKATGADKPIGHPKPVGIKKALVFYAGKAPRGEKTNWIMHEYRLADVDRSARKKCNNSLRLDDWVLCRIYNKKGSIEKQNTVIDKKLSEIPEMFEQKPQILNHHGGGVMLSPPPESPPATRMFSELVYRDTSDSIPRLHTDSSCSEHVVSPEFTCEREVQSEPSKLTDWEKAALDFPFNYMDATMDNAFTSPLQDMFMYLQKPF

SEQ ID NO: 79 - protein, 300 aa, Ipomoea batatas
  misc_feature (1)..(300): Public GI ID no. 254034330
  misc_feature (21)..(145): Pfam Name: NAM Pfam Description: No apical meristem (NAM) protein
  misc_feature (1)..(300): Bit score of 540.1 for HMM based on sequences of Figure 4
  misc_feature (1)..(300): Functional Homolog Of SEQ ID NO. 2
MKNNGGILNNNEQQQQQQLEMPPGFRFHPTDEELVVHYLCRKCASQSISVPIIAEIDLYKFDPWQLPDMALYGEKEWYFFSPRDRKYPNGSRPNRAAGTGYWKATGADKPVGRPKTLGIKKALVFYAGKAPKGVKTNWIMHEYRLANVDRSAGKKNNLRLDDWVLCRIYNKKGTVEKYYNAADQNDIILPKVEDQKPNINQFSQSGTMLKQAALPPMVQNQHDYMHFDTSESVLRWHTDSSCCSEQVLSSPEFAADKEVQSAPKWDDLDFQLNNFIDDPFQVPQYNDPFQDMFTYMHKPF

SEQ ID NO: 80 - DNA, 1240 bp, Gossypium hirsutum
  misc_feature (1)..(1240): Ceres Clone ID no. 100066176
  misc_feature (1)..(1240): Encodes the peptide sequence at SEQ ID NO. 81
caaaaaaccacccagtaccaacagccaacaacacaaagaaggcaaacttacagcttttttgaagaggatcagctctagaaagttaagtctaaaaaggaagaagagtttaaagagttcagagaatgaaggcagagttagagttgccacctggtttcagattccatcctacagatgacgaactggtgaatcattatttgtgtaggaaatgtgcttctcagcctatttctgtgcccatcattgctgagattgatctttacaagtttgatccatggcagcttccagatatggcgttgtatggtgaaaaagagtggtatttcttttctccaagggatcgaaaatacccaaatgggtgtcggccgaacagggcggctggaaccggatactggaaagcgaccggagccgataagcccatcggaaagcccaagacactgggcataaaaaaagcactcgttttctacgctggtaaagccccacgcggtgtcaaaaccaactggattatgcacgagtatcgcctcgccaatgttgataggtccgccggcaagaaaagcaacaacttgaggcttgatgattgggtgttatgtcgaatatacaacaaaaagggaagcatagagaaacattttccgagtgaacaaaaatcgttaagttacccagaaatggaagatgagaaaccggacatcataatgaatggtcaaaacatgcaacaaccatggtcggtgatggcgatgaagaacgatgtaatacaaacggatggttcggagtcgagttggtcggagcacgtgccgtcaccggaaatcacgtgggagaaagaagtgaaaagtgaagggagatggaatgagcttgatttcgggttggatttcatagatgaagacccatttgccagtcaagttgattaccaaatggagcaactgtcaccattgcaagacatgttcatgtatctacccaagacattttaagccaacgtagaccaaaaatcctacaattgtggggtccaatccaaattaaaaacatttttaatttagatccatgcacacacacattgccaaacgaacaatgggtcaaattcaaattcaatatgagggggtgggtgacaaacaattggatcgctcgtgggtgtaatataatatgagccgtccattttcttcattttgaatattcaacgaaattgtaggaatattcttgtaatatatgtagaccatttttttcaaatatgaatattatgaaatatgctatgttgctattt

SEQ ID NO: 81 - protein, 276 aa, Gossypium hirsutum
  misc_feature (1)..(276): Ceres Clone ID no. 100066176
  misc_feature (7)..(131): Pfam Name: NAM Pfam Description: No apical meristem (NAM) protein
  misc_feature (1)..(276): Bit score of 506.7 for HMM based on sequences of Figure 4
  misc_feature (1)..(276): Functional Homolog Of SEQ ID NO. 2
MKAELELPPGFRFHPTDDELVNHYLCRKCASQPISVPIIAEIDLYKFDPWQLPDMALYGEKEWYFFSPRDRKYPNGCRPNRAAGTGYWKATGADKPIGKPKTLGIKKALVFYAGKAPRGVKTNWIMHEYRLANVDRSAGKKSNNLRLDDWVLCRIYNKKGSIEKHFPSEQKSLSYPEMEDEKPDIIMNGQNMQQPWSVMAMKNDVIQTDGSESSWSEHVPSPEITWEKEVKSEGRWNELDFGLDFIDEDPFASQVDYQMEQLSPLQDMFMYLPKTF

SEQ ID NO: 82 - protein, 299 aa, Gossypium hirsutum
  misc_feature (1)..(299): Public GI ID no. 206584339
  misc_feature (8)..(132): Pfam Name: NAM Pfam Description: No apical meristem (NAM) protein
  misc_feature (1)..(299): Bit score of 605.0 for HMM based on sequences of Figure 4
  misc_feature (1)..(299): Functional Homolog Of SEQ ID NO. 2
MTASELQLPPGFRFHPTDEELVMHYLCRKCASQSIAVPIIAEIDLYKYDPWDLPDLALYGEEEWYFFSPRDRKYPNGSRPNRAAGSGYWKATGADKPIGQPKPVGIKKALVFYAGKAPKGEKTNWIMHEYRLADVDRSARKKNSLRLDDWVLCRIYNKKGAIEKQSPQGSIGKSSAVTEIEDKKPDIATLGVDTRQLPPPPTGLGNDYVYFDTSESVPRLHTDSSCSEHVVSPEFTCEVQSEPQWKDWGSATNTTTTNALDFPYNYMDATVDNGFPAHFQSNNQLSPLQDMFMYLQKPF

SEQ ID NO: 83 - protein, 291 aa, Populus trichocarpa
  misc_feature (1)..(291): Public GI ID no. 224063050
  misc_feature (8)..(132): Pfam Name: NAM Pfam Description: No apical meristem (NAM) protein
  misc_feature (1)..(291): Bit score of 598.9 for HMM based on sequences of Figure 4
  misc_feature (1)..(291): Functional Homolog Of SEQ ID NO. 2
MTAATLELPPGFRFHPTDEELVLHYLCRKCSSQPIAVPIIAEIDLYKFDPWDLPGIALYGEKEWYFFTPRDRKYPNGSRPNRAAGRGYWKATGADKPIGQPKTVGIKKALVFYAGKAPKGEKTNWIMHEYRLADVDRSARKKNSLRLDDWVLCRIYNKKGTVEKQEQHLSVKKANPTEIEEDEKKQVVLLPPPQAPSSATGTVNDYMYFDTSDSVPRMHTDSSCSEHVVSPEFTCEVQSEPRWKEWGNVNALDNPYNYLDATMDIPFASQLQGDNQMSPLQDIFMHLQKPF

SEQ ID NO: 84 - protein, 290 aa, Eutrema halophilum
  misc_feature (1)..(290): Public GI ID no. 312282805
  misc_feature (6)..(130): Pfam Name: NAM Pfam Description: No apical meristem (NAM) protein
  misc_feature (1)..(290): Bit score of 555.2 for HMM based on sequences of Figure 4
  misc_feature (1)..(290): Functional Homolog Of SEQ ID NO. 2
MSELQLPPGFRFHPTDEELVMHYLCRKCASQSISVPIIAEIDLYKYDPWELPGLALYGEKEWYFFSPRDRKYPNGSRPNRSAGSGYWKATGADKPIGVPKPVGIKKALVFYAGKAPKGEKTNWIMHEYRLADVDRSVRKKKNSLRLDDWVLCRIYNKKGALERRGPPPPEVHGGGVTDEAVEEKPRLTEMGMPPPPQQTANEFVYFDTSDSVPKLHTTESSCSEHVVSPEFTSEVQSEPKWKDWSAATNGNNTLDFGYNYMDATVDNAFGGGSNQMFPLQDMFMYMQKPY

SEQ ID NO: 85 - protein, 369 aa, Ricinus communis
  misc_feature (1)..(369): Public GI ID no. 255558632
  misc_feature (85)..(209): Pfam Name: NAM Pfam Description: No apical meristem (NAM) protein
  misc_feature (1)..(369): Bit score of 609.6 for HMM based on sequences of Figure 4
  misc_feature (1)..(369): Functional Homolog Of SEQ ID NO. 2
MWAIDTHAPPLERRTRVPAAVIEEKTRKKGKKRYRPRFQAPSPQRERKQESESIYSCSRSRISRVEEKGKQVKGKKNDMAAVLELPPGFRFHPTDEELVMHYLCRKCASQQIAVPIIAEIDLYKYDPWDLPGMALYGEKEWYFFSPRDRKYPNGSRPNRAAGSGYWKATGADKPIGQPKPVGIKKALVFYAGKAPKGEKTNWIMHEYRLADVDRSARKKNSLRLDDWVLCRIYNKKGTIEKQGQLSNKKIINYSPSNIIEDKKPEIMAPPPAPSSGTGTANDFVYFESSDSVPKLHTDSSCSEHVVSPEFTCEVQSEPKWKDWGSNVNALDFPFNYMDGSMDSAFASQFQNNNQMSPLQDMFMYLQKPF

SEQ ID NO: 86 - protein, 312 aa, Petunia x hybrida
  misc_feature (1)..(312): Public GI ID no. 21105734
  misc_feature (13)..(137): Pfam Name: NAM Pfam Description: No apical meristem (NAM) protein
  misc_feature (1)..(312): Bit score of 571.9 for HMM based on sequences of Figure 4
  misc_feature (1)..(312): Functional Homolog Of SEQ ID NO. 2
MIKGVSGNQQLELPAGFRFHPTDEELVQHYLCQKCAGQPICVSIIAEIDLYKFDPWQLPEKALYGEKEWYFFSPRDRKYPNGSRPNRAAGTGYWKATGADKPVGKPRTLGIKKALVFYAGKAPRGIKTNWIMHEYRLANVDRSAGKSNNLRLDDWVLCRIYNKKGTLEKHYNVDNKEDVRFEEVEEDQKPNILTFSQRNEMLTQLAPAPMPPRPQSMPASDYFHFETSDSVTRMHTTNSSSNCSEHVLSSCDKEVQSAPTWEDLESALNYQLNYLDGFQDEPFGPQMQQQNCNIIDQFNPFHDMFMYMQKPY

SEQ ID NO: 87 - protein, 324 aa, Picea sitchensis
  misc_feature (1)..(324): Public GI ID no. 116784797
  misc_feature (20)..(147): Pfam Name: NAM Pfam Description: No apical meristem (NAM) protein
  misc_feature (1)..(324): Bit score of 419.8 for HMM based on sequences of Figure 4
  misc_feature (1)..(324): Functional Homolog Of SEQ ID NO. 2
MREIGRMGCKSGPNSAQINLPPGFRFYPTDEELMVHYLCKRVASQPFPIPIIAEIDLYKFDPWQLPEKALFGEKEWYFFSPRDRKYPNGSRPNRAAGSGYWKATGTDKPVTAGLNRMKVGVKKALVFYKGKAPRGIKTNWIMHEYRLADSASKAAKRKGSIRLDDWVLCRIYEKHYASQKAVPKESNELSSCVDPEEDQYMAPVASNSPPDMDDNKLLINLPRINSLNRINSLLKFPSREIMKMPDPNYNQTEQQYSRAEADAGSNSGGQAIEYGQNSPFWRNQQFGYNYDQMAQNPFPQQLEHMPSLGANSSAFFASLAAELL

SEQ ID NO: 88 - protein, 298 aa, Glycine max
  misc_feature (1)..(298): Public GI ID no. 187940307
  misc_feature (7)..(131): Pfam Name: NAM Pfam Description: No apical meristem (NAM) protein
  misc_feature (1)..(298): Bit score of 531.5 for HMM based on sequences of Figure 4
  misc_feature (1)..(298): Functional Homolog Of SEQ ID NO. 2
MPGELQLPPGFRFHPTDDELVNHYLCRKCAAQTIAVPIIKEIDLYKFDPWQLPEMALYGEKEWYFFSPRDRKYPNGSRPNRAAGSGYWKATGADKPIGNPKALGIKKALVFYAGKAPKGVKTNWIMHEYRLANVDRSASKKNTTTNNLRLDDWVLCRIYNKKGKIEKYNGVAVVDQKVAKLSEEEVQFQHETKPQIKMYGHDDFRNDQLYMDTSDSGPRLHTDSSCSEHVVSPDGTCEKEVQSEPKWNDLELGPDPALGFDFNFMDLTSDDAIAPQVQYQINHLSPWQEMFTYLPKTF

SEQ ID NO: 89 - protein, 268 aa, Glycine max
  misc_feature (1)..(268): Public GI ID no. 184097796
  misc_feature (9)..(133): Pfam Name: NAM Pfam Description: No apical meristem (NAM) protein
  misc_feature (1)..(268): Bit score of 497.8 for HMM based on sequences of Figure 4
  misc_feature (1)..(268): Functional Homolog Of SEQ ID NO. 2
MAAATQLHLPPGFRFHLTDEELVVHYLCRKCASQEIAVPIIAEIDLYKYDPWDLPGMALYGKKEWYFFTPRDRKYPNGSRPNRSAGTGYWKATGADKPVGKPKPVGIKKALVFYAGKAPKGVKTNWIMHEYRLADVDRSVRKKNSLRLDDWVLCRIYNKKGAIEKQQPAPPPPSGVHKIECYEMEDVKPEYTAADCLYFEASDSVPRLHTTESSCSEQVVSAEFASEVQSERKRQGNSEFSYNYMDATLGNNQMSPLQDIFMYLSRPF

SEQ ID NO: 90 - protein, 353 aa, Oryza sativa
  misc_feature (1)..(353): Public GI ID no. 222631638
  misc_feature (1)..(353): Oryza sativa Japonica Group
  misc_feature (18)..(142): Pfam Name: NAM Pfam Description: No apical meristem (NAM) protein
  misc_feature (1)..(353): Bit score of 469.8 for HMM based on sequences of Figure 4
  misc_feature (1)..(353): Functional Homolog Of SEQ ID NO. 2
MSGGGEGAAAAERQELQLPPGFRFHPTDEELVMHYLCRRCAGLPIAVPIIAEVDLYKFDPWHLPRMALYGEKEWYFFSPRDRKYPNGSRPNRAAGSGYWKATGADKPVGTPRPVAIKKALVFYAGKAPKGDKTNWIMHEYRLADVDRSARKKNTLRLDDWVLCRIYNKKGGVEKPSGGGGGERSNMMSHGETASAGSPPEQKPAVLPPPPPPYAAAAPFSELAAFYDVRPSDSVPRAQGADSSCSEHVLTTSASSGGVVERPEVQSHPKIAELGPQVWRVRAPRFAAFDNTRATSQRFRPSSGEPSGRLGAACAVPTGRAWWWVAQIREVGSTARDRIKELICGEAMLVAHRR

SEQ ID NO: 91 - protein, 324 aa, Picea sitchensis
  misc_feature (1)..(324): Public GI ID no. 116782512
  misc_feature (20)..(147): Pfam Name: NAM Pfam Description: No apical meristem (NAM) protein
  misc_feature (1)..(324): Bit score of 420.0 for HMM based on sequences of Figure 4
  misc_feature (1)..(324): Functional Homolog Of SEQ ID NO. 2
MREIGRMGCKSGPNSAQINLPPGFRFYPTDEELMVHYLCKRVASQPFPIPIIAEIDLYKFDPWQLPEKALFGEKEWYFFSPRDRKYPNGSRPNRAAGSGYWKATGTDKPVTAGLNRMKVGVKKALVFYKGKAPRGIKTNWIMHEYRLADSASKAAKRKGSIRLDDWVLCRIYEKHYASQKAVPKESNELSSCVDPEEDQYMAPVASNSPPDMDDNKLLINLPRINSLNRINSLLKFPSREIMKMPDPNYNQTEQQYSRAETDAGSNSGGQAIEYGQNSPFWRNQQFGYNYDQMAQNPFPQQLEHMPSLGANSSAFFASLAAELL

SEQ ID NO: 92 - DNA, 1227 bp, Arabidopsis thaliana
  misc_feature (1)..(1227): Ceres Clone ID no. 1220729
  misc_feature (1)..(1227): Encodes the peptide sequence at SEQ ID NO. 93
gatttcaatctttgagataaaccacaaagatcctccgattcgaaggtttataaaaactcaaaatcgaatcttatccacaagaaaacaacaaggtacttttccaaaaatgaaggcggagttgaatttgccggcgggattccgatttcatccgacggacgaagagcttgtcaagttctatctttgccggagatgtgcgtcagaaccgattaacgttccggttatcgcagagattgacttgtacaaattcaatccatgggagcttccagaaatggcgttgtacggtgagaaagaatggtacttcttctcgcatagagaccggaaatacccaaacgggtcgagaccaaaccgggcagctggaaccggttattggaaagcgactggagctgataaaccgatcggaaaaccgaagacgttagggattaagaaagcactcgtcttctacgcaggaaaagctccgaaagggattaaaacgaattggattatgcacgagtatcgtctcgctaatgtcgatcgatctgcttctaccaacaagaagaacaacttaagacttgatgattgggttttgtgtcggatatacaataagaaaggaacaatggagaagtatttaccggcggcggctgagaaaccgacggaaaagatgagtacgtcggactcaagatgctcaagtcacgtgatttcaccggacgtcacgtgttctgataactgggaggttgagagtgagcccaaatggattaatctggaagacgcgttagaggcatttaatgatgacacgtccatgtttagttccattggtttgttgcaaaatgacgcctttgttcctcagtttcagtaccagtcctccgatttcgtcgattcgtttcaggacccgttcgagcagaaaccgttcttgaattggaattttgctcctcaagggtaaaaataatcggcaaaaagttgaagcttttcagagtcttcgatcaccggcattgtgtcggatcctgacccggagaccaagtcgggtcatacgattacataatcgggttattgagatttccacatttggatttccgagactaaccaacttaacggattctggggtaattggggggttttgcacaggtgaatcacactgagtcagcaagtttcgattttttggttttgttttgtaatgattgattaaatgtctaaagatatcacgaagtagatacagaagaactgtaaaagcaattgtgaccaaccattatgaat

SEQ ID NO: 93 - protein, 269 aa, Arabidopsis thaliana
  misc_feature (1)..(269): Ceres Clone ID no. 1220729
  misc_feature (7)..(131): Pfam Name: NAM Pfam Description: No apical meristem (NAM) protein
  misc_feature (1)..(269): Bit score of 435.5 for HMM based on sequences of Figure 4
  misc_feature (1)..(269): Functional Homolog Of SEQ ID NO. 2
MKAELNLPAGFRFHPTDEELVKFYLCRRCASEPINVPVIAEIDLYKFNPWELPEMALYGEKEWYFFSHRDRKYPNGSRPNRAAGTGYWKATGADKPIGKPKTLGIKKALVFYAGKAPKGIKTNWIMHEYRLANVDRSASTNKKNNLRLDDWVLCRIYNKKGTMEKYLPAAAEKPTEKMSTSDSRCSSHVISPDVTCSDNWEVESEPKWINLEDALEAFNDDTSMFSSIGLLQNDAFVPQFQYQSSDFVDSFQDPFEQKPFLNWNFAPQG

SEQ ID NO: 94 - protein, 301 aa, Solanum tuberosum
  misc_feature (1)..(301): Public GI ID no. 14485513
  misc_feature (13)..(137): Pfam Name: NAM Pfam Description: No apical meristem (NAM) protein
  misc_feature (1)..(301): Bit score of 534.2 for HMM based on sequences of Figure 4
  misc_feature (1)..(301): Functional Homolog Of SEQ ID NO. 2
MNKGATGNQQLELPAGFRFHPTDDELVQHYLCRKCAGQPIAVSIITEIDLYKFDPWQLPEKALYGEKEWYFFSPRDRKYPNGSRPNRAAGTGYWKATGADKPVGKPKTLGIKKALVFYAGKAPRGIKTNWIMHEYRLANVDRSAGKNNNLRLDDWVLCRIYNKKGTLEKHYNVDNKETASFGEFDEEIKPKILPTQLAQMPPRPRSTPTNDYFHFESSESMTRMHTTNSSSGSEHVLSPCDKEVQSAPKWDEDHRNTLDFQLNYLDGLLNEPFETQMQQQSCNFDQFNNFQDMFFYMQKPY

SEQ ID NO: 95 - DNA, 1191 bp, Glycine max
  misc_feature (1)..(1191): Ceres Clone ID no. 514804
  misc_feature (1)..(1191): Encodes the peptide sequence at SEQ ID NO. 96
aagtttcaaacgccgcaaccaccacacaattcctacacatttctactctttagtttctccaattttctttctcaattctcaacaatggccactacaacacaacttcacttaccccctggattcagattccatccaacagatgaagaactcgtcatccactacctttgtcgcaaatgcgcttcgcaacatatcgcggttcccataatcgccgaaattgatctgtacaagtacgacccttgggaccttccaggaatggctttgtacggagagaaagagtggtattttttcacgccgagggaccgcaagtacccgaacggttcgcggccgaaccggtccgcgggaaccgggtactggaaggcaaccggagcggataaaccagttggtaaaccgaaaccggttgggatcaagaaagcgttggttttttacgctggaaaagcgcccaagggagagaaaactaactggatcatgcacgagtatcgtcttgcagacgtggatcgttccgttcgcaaaaagaacagcttaaggctggatgactgggtgctgtgccgaatttacaacaagaaaggtgcaattgaaaagcaacaactaccaccaccgagtggggtccgcaaaattgaatgttccgaaatggaggacgagaagccggagattctgccgccagatccgccgtatacggcggcgacggtggcggattgcctgtacttcgaggcttccgactcggtgccccggctgcacacgacggactcgagctgctccgagcaggtggtgtcggcggagtttgcgagcgaggtgcagagcgagccgaagaggggcagcaacaacaacaacgagtttgcatataattacgtggatgccactctcgggaataatcagatgtcgccgctgcaggatattttcatgtacctctccaagtccttctgcaattaacacgcaccaccaccacgacgagacgacgtcgttctgtgttgtgtgtatgcattatgcatttttgcagtagctgctccactgcaccatttgcacggaagcacgagactgagtgaagatccgtgagtgtgtccgtgctggttcgtgtagacgattattacaaaaaaaaacaaaaaagcaccaagatgaagaagaagaaagattcttatatgaacatgatgaattatgagtatattaaattaatgaagtattaatacatcattgagc

SEQ ID NO: 96 - protein, 280 aa, Glycine max
  misc_feature (1)..(280): Ceres Clone ID no. 514804
  misc_feature (9)..(133): Pfam Name: NAM Pfam Description: No apical meristem (NAM) protein
  misc_feature (1)..(280): Bit score of 524.5 for HMM based on sequences of Figure 4
  misc_feature (1)..(280): Functional Homolog Of SEQ ID NO. 2
MATTTQLHLPPGFRFHPTDEELVIHYLCRKCASQHIAVPIIAEIDLYKYDPWDLPGMALYGEKEWYFFTPRDRKYPNGSRPNRSAGTGYWKATGADKPVGKPKPVGIKKALVFYAGKAPKGEKTNWIMHEYRLADVDRSVRKKNSLRLDDWVLCRIYNKKGAIEKQQLPPPSGVRKIECSEMEDEKPEILPPDPPYTAATVADCLYFEASDSVPRLHTTDSSCSEQVVSAEFASEVQSEPKRGSNNNNEFAYNYVDATLGNNQMSPLQDIFMYLSKSFCN

SEQ ID NO: 97 - protein, 296 aa, Solanum tuberosum
  misc_feature (1)..(296): Public GI ID no. 155008462
  misc_feature (8)..(132): Pfam Name: NAM Pfam Description: No apical meristem (NAM) protein
  misc_feature (1)..(296): Bit score of 607.3 for HMM based on sequences of Figure 4
  misc_feature (1)..(296): Functional Homolog Of SEQ ID NO. 2
MTAAELQLPPGFRFHPTDEELVTHYLCRKCTSQPIAVPIVTEIDLYKFDPWDLPDLALYGEKEWYFFSPRDRKYPNGSRPNRAAGSGYWKATGADKPIGIPKAVGIKKALVFYSGKAPKGEKTNWIMHEYRLADVDRSARKNNNSLRLDDWVLCRIYNKKGSIEKNRKMNTTCYMDTVGSPEDRKPEILPPLPPPPQPQQLHNDFFYLPSDSVPKIHSDSSCSEHVLSPEFTCEREVQSEPKLTDWEKATLDLPFNYMDATTGATTVDNSLLGSQFQSCYQMSPLQDMFMHLHRPF

SEQ ID NO: 98 - protein, 298 aa, Triticum aestivum
  misc_feature (1)..(298): Public GI ID no. 292659252
  misc_feature (9)..(133): Pfam Name: NAM Pfam Description: No apical meristem (NAM) protein
  misc_feature (1)..(298): Bit score of 503.1 for HMM based on sequences of Figure 4
  misc_feature (1)..(298): Functional Homolog Of SEQ ID NO. 2
MSGGQELNLPPGFRFHPTDEELVTHYLCRRCAGAPIAVPIITEIDLYKFDPWQLPKMALYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGLEKPASVDRKPAAMGGYGGPPGAMVSSPQEQKPVMGMNANGGGGVQPFPDFAAYYDRPSDSMPRLHADSSCSEQMLSPDFPAGEVQSQPKISEWERSFASGGDPVNPAAGSMLEPNGGFGGDPLLQDILMYWGKPF

SEQ ID NO: 99 - protein, 298 aa, Triticum aestivum
  misc_feature (1)..(298): Public GI ID no. 296044564
  misc_feature (9)..(133): Pfam Name: NAM Pfam Description: No apical meristem (NAM) protein
  misc_feature (1)..(298): Bit score of 505.7 for HMM based on sequences of Figure 4
  misc_feature (1)..(298): Functional Homolog Of SEQ ID NO. 2
MSGGQELNLPPGFRFHPTDEELVTHYLCRRCAGAPIAVPIITEIDLYKFDPWQLPKMALYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGLEKPASVDRKPAAMGGYGGPPGAMVSSPQEQKPVMGMNANGGGGVQPFPDFAAYYDRPSDSMPRLHADSSCSEQVLSPDFPAGEVQSQPKISEWERSFASGGDPVNPAAGSMLEPNGGFGGDPLLQDILMYWGKPF

SEQ ID NO: 100 - protein, 280 aa, Glycine max
  misc_feature (1)..(280): Public GI ID no. 187940295
  misc_feature (9)..(133): Pfam Name: NAM Pfam Description: No apical meristem (NAM) protein
  misc_feature (1)..(280): Bit score of 520.3 for HMM based on sequences of Figure 4
  misc_feature (1)..(280): Functional Homolog Of SEQ ID NO. 2
MATTTQLHLPPGFRFHPTDEELVIHYLCRKCASQHIAVPIIAEIDLYKYDPWDLPGMALYGEKEWYFFTPRDRKYPNGSRPNRSAGTGYWKATGADKPVGKPKPVGIKKALVFYAGKAPKGEKTNWIMHEYRLADVDRSVRKKNSLRLDDWVLCRIYNKKGAIEKQQLPPPSGVRKIECSEMEDEKPEILPPDPPYTAATVADCLYFEASDSVPRLHTTDSSCSEQVVSAEFASEVHSEPKRGSNNNNEFAYNYVDATLGNNQMSPLQDIFMYLSKSFCN

SEQ ID NO: 101 - DNA, 1005 bp, Sorghum bicolor
  misc_feature (1)..(1005): Ceres Annot ID no. 8732688
  misc_feature (1)..(1005): Encodes the peptide sequence at SEQ ID NO. 102
atgagcggcggcggcggcggaggccgagcgccggcggcgcagtcgcaggagctgcagctgccgccggggttccggttccacccgaccgacgaggagctggtgatgcactacctctgccggcgctgcgccgggcttcccatctccgtgcccatcatcgccgagatcgatctctacaagttcgacccctggcagctcccaaggatggcgctgtacggcgagaaggagtggtacttcttctcgccgcgggaccgcaagtacccgaacgggtcgcggccgaaccgcgccgccggcgccgggtactggaaggccaccggtgcagacaagccggtgggcacgccgaagccgttggccatcaagaaggcgctcgtcttctacgccggcaaggcgcccaagggcgacaagaccaactggatcatgcatgagtaccgcctcgccgacgtcgaccgcaccgcccgcaacaagaacaacagcctcaggttggatgattgggtactgtgccgaatctacaacaagaaaggcgtgccggagaggccggccggagccggcggggccgaggcgagcagccagcaaggcgcgcaggggtcgatgggctcgccgccggagcagaagccgtccgtgccgccgcatcccacggccggggcggggttatacgcgccgccgccgttctcggacctggcggcgtactgcgaggtccggccgtcggactccatgccccgggcgcacggcgcggactcgagctgctcgggccagggccacgcgctggccgccacgtcgtcgtcgtgcggcggcggcgagcggcctgaggtgcagagccagcccaagatcgccgagtgggagcgcacgttcgccggcgccggtgccggtccggggatcaacccggccggctcgatgctggggcttggcgggcatcatcagctcggcccggcggcggtgggggtggggcagctgcccgccggcgacccgctgctgcaggacatcctcacgtactggggcaaaccgtactga

SEQ ID NO: 102 - protein, 334 aa, Sorghum bicolor
  misc_feature (1)..(334): Ceres Annot ID no. 8732688
  misc_feature (20)..(144): Pfam Name: NAM Pfam Description: No apical meristem (NAM) protein
  misc_feature (1)..(334): Bit score of 463.6 for HMM based on sequences of Figure 4
  misc_feature (1)..(334): Functional Homolog Of SEQ ID NO. 2
MSGGGGGGRAPAAQSQELQLPPGFRFHPTDEELVMHYLCRRCAGLPISVPIIAEIDLYKFDPWQLPRMALYGEKEWYFFSPRDRKYPNGSRPNRAAGAGYWKATGADKPVGTPKPLAIKKALVFYAGKAPKGDKTNWIMHEYRLADVDRTARNKNNSLRLDDWVLCRIYNKKGVPERPAGAGGAEASSQQGAQGSMGSPPEQKPSVPPHPTAGAGLYAPPPFSDLAAYCEVRPSDSMPRAHGADSSCSGQGHALAATSSSCGGGERPEVQSQPKIAEWERTFAGAGAGPGINPAGSMLGLGGHHQLGPAAVGVGQLPAGDPLLQDILTYWGKPY

SEQ ID NO: 103 - protein, 176 aa, Selaginella moellendorffii
  misc_feature (1)..(176): Public GI ID no. 302789271
  misc_feature (15)..(141): Pfam Name: NAM Pfam Description: No apical meristem (NAM) protein
  misc_feature (1)..(176): Bit score of 242.9 for HMM based on sequences of Figure 4
  misc_feature (1)..(176): Functional Homolog Of SEQ ID NO. 2
MAPAKFSTSSSQLHLPAGFRFHPTDEELVVHYLCKKAESKPFPVPVIAEVDLYKFSPWDLPSKAYFGEREWYFFTPRDRKYPNGARPNRAAGSGYWKATGTDKPIHTRGNRKVGVKKALVFYDGKAPKGVKTNWIMHEYRLVESSSHKPAKDHKSLRLDDWVLCRIYEKTSGAFKV

SEQ ID NO: 104 - protein, 276 aa, Gossypium hirsutum
  misc_feature (1)..(276): Public GI ID no. 206584337
  misc_feature (7)..(131): Pfam Name: NAM Pfam Description: No apical meristem (NAM) protein
  misc_feature (1)..(276): Bit score of 491.9 for HMM based on sequences of Figure 4
  misc_feature (1)..(276): Functional Homolog Of SEQ ID NO. 2
MKAELELPPGFRFHPTDDELVNHYLCRKCASQPISVPIIAEIDLYKFDPWQLPDMALYGEKEWYFFSPRDRKYPNGCRPNRAAGTGYWKATGADKPIGGPKALGIKKALVFYAGKAPRGVKTNWIMHEYRLANVDRSAGKRSNNLRLDDWVLCRIYNKKGSIEKHFPSEQKSLSYPEMEDEKLGIIMNGQNMQQPWSVMAMKNDAIQTDGSESSWSEHVPSPEITWEKEVKSEGRWNELDFGLDFIDEDPFASQVDYQMEQLSPLQDRFMYLPKTF

SEQ ID NO: 105 - protein, 304 aa, Hordeum vulgare
  misc_feature (1)..(304): Public GI ID no. 326490045
  misc_feature (1)..(304): Hordeum vulgare subsp. vulgare
  misc_feature (9)..(133): Pfam Name: NAM Pfam Description: No apical meristem (NAM) protein
  misc_feature (1)..(304): Bit score of 506.7 for HMM based on sequences of Figure 4
  misc_feature (1)..(304): Functional Homolog Of SEQ ID NO. 2
MSGGQELNLPPGFRFHPTDEELVMHYLCRRCAGAPIAVPIITEIDLYKFDPWQLPKMAMYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGMEKPASVDRKPVTMGGYGVGPGAMVSSPQEQKPVMGMNANGGGGGGVQPFPDFAAYYDRPSDSMPRLHADSSCSEQVLSPDFPGERGGGEVQSQPKISEWERSFASGGDPVNPAAGSILEPHGGFGGDPLLQDILMYWGKPF

SEQ ID NO: 106 - protein, 265 aa, Brassica napus
  misc_feature (1)..(265): Public GI ID no. 31322570
  misc_feature (7)..(131): Pfam Name: NAM Pfam Description: No apical meristem (NAM) protein
  misc_feature (1)..(265): Bit score of 457.1 for HMM based on sequences of Figure 4
  misc_feature (1)..(265): Functional Homolog Of SEQ ID NO. 2
MKAELNLPAGFRFHPTDEELVKFYLCRRCASEPITVPVIAEIDLYKFNPWELPDKALYGEKEWYFFSHRDRKYPNGSRPNRAAGTGYWKATGADKPIGKPKTLGIKKALVFYAGKAPRGVKTNWIMHEYRLANVDRSASSNKKNNLRLDDWVLCRIYNKKGTVEKYYPADEKERVMMMTTNTTTTSDSKCSSHVISPDVTCSSEVQSESKWVVDLDDAFDASMFGSLLQNDAFVPQFPYQSDFASMFEDPLEQKPFFNWSFGSQG

SEQ ID NO: 107 - protein, 205 aa, Physcomitrella patens
  misc_feature (1)..(205): Public GI ID no. 168000027
  misc_feature (1)..(205): Physcomitrella patens subsp. patens
  misc_feature (14)..(142): Pfam Name: NAM Pfam Description: No apical meristem (NAM) protein
  misc_feature (1)..(205): Bit score of 292.0 for HMM based on sequences of Figure 4
  misc_feature (1)..(205): Functional Homolog Of SEQ ID NO. 2
MSSPSGGPVAQLQLPPGFRFHPTDEELVLHYLCRKAESKVFAIPVIAEIDLYKFDPWDLPGKAIFGEREWYFFSPRDRKYPNGARPNRAAASGYWKATGTDKPIHTAVGGIRKIGVKKALVFYEGRAPKGVKTNWIMHEYRLAEGVCASVHAHRKGSLRLDDWVLCRIYKKSTNAQRTGKERDSSSCVEEVTSHLDCMPDLTSFE

SEQ ID NO: 108 - protein, 250 aa, Arabidopsis lyrata
  misc_feature (1)..(250): Public GI ID no. 297839605
  misc_feature (1)..(250): Arabidopsis lyrata subsp. lyrata
  misc_feature (11)..(134): Pfam Name: NAM Pfam Description: No apical meristem (NAM) protein
  misc_feature (1)..(250): Bit score of 439.6 for HMM based on sequences of Figure 4
  misc_feature (1)..(250): Functional Homolog Of SEQ ID NO. 2
MMKSGADLQFPPGFRFHPTDEELVLMYLCRKCASQPIPAPIITELDLYRYDPWDLPDMALYGEKEWYFFSPRDRKYPNGSRPNRAAGTGYWKATGADKPIGRPKPVGIKKALVFYSGKPPNGEKTNWIMHEYRLADVDRSVRKKNSLRLDDWVLCRIYNKKGVIEKQRSENELRAVNDTCPPESVERLIAGSEQVVSQEFTCSNGRLSNALDFPFNYVDAIADNEIVSRLLSGNQMWSTLDPLVVRQRTF

SEQ ID NO: 109 - protein, 299 aa, Glycine max
  misc_feature (1)..(299): Public GI ID no. 62546185
  misc_feature (7)..(131): Pfam Name: NAM Pfam Description: No apical meristem (NAM) protein
  misc_feature (1)..(299): Bit score of 592.9 for HMM based on sequences of Figure 4
  misc_feature (1)..(299): Functional Homolog Of SEQ ID NO. 2
MASELELPPGFRFHPTDEELVLHYLCRKCASQPIAVPIIAEIDLYKYDPWDLPGLATYGEKEWYFFSPRDRKYPNGSRPNRAAGTGYWKATGADKPIGQPKPVGIKKALVFYAGKAPKGDKSNWIMHEYRLADVDRSVRKKNTLRLDDWVLCRIYNKKGTIEKLQPSSDVAHSRNIESSEIEDRKPEILKSGGGCLPPPAPVPAPPQATAKTDYMYFDPSDSIPKLHTDSSCSEQVVSPGFASEVQSEPKWNEWEKSLEFPFNYVDATLNNSFMAQFQGNNQMLSPLQDMFMYWPNKSF

SEQ ID NO: 110 - protein, 333 aa, Vitis vinifera
  misc_feature (1)..(333): Public GI ID no. 147802535
  misc_feature (14)..(139): Pfam Name: NAM Pfam Description: No apical meristem (NAM) protein
  misc_feature (1)..(333): Bit score of 366.0 for HMM based on sequences of Figure 4
  misc_feature (1)..(333): Functional Homolog Of SEQ ID NO. 2
  misc_feature (121)..(121): Xaa is any aa, unknown or other
MGVPETDPLSQLSLPPGFRFYPTDEELLVQYLCRKVAGQGFSLEIIGEIDLYKFDPWVLPSKAIFGEKEWYFFSPRDRKYPNGSRPNRVAGSGYWKATGTDKVITTEGRKVGIKKALVFYXGKAPKGTKTNWIMHEYRLLENSRKNGSSKLDDWVLCRIYKKNSNSSKPIAAVLPSKAHSNGSSSSSSSHLDDVLESLPEIDDRFFSPNRMNSLRVSQPDEKVNFHNLGSGNFDWATLAGVSSLQELVSGVQSHAQPPAAVNNSNEMYVPSLPPLIQAEEEVQSGLRTQRVDPVMNQGFFPQNSNAFSQSFSNSLDPFGFRYPTQPSGFGYRQ

SEQ ID NO: 111 - protein, 181 aa, Selaginella moellendorffii
  misc_feature (1)..(181): Public GI ID no. 302820063
  misc_feature (14)..(139): Pfam Name: NAM Pfam Description: No apical meristem (NAM) protein
  misc_feature (1)..(181): Bit score of 268.3 for HMM based on sequences of Figure 4
  misc_feature (1)..(181): Functional Homolog Of SEQ ID NO. 2
MEHNSKKAVNSLQLPPGFRFHPTDEELVVHYLARRAASRPFAVPIIAEVDLYKFDPWDLPDKALFGEREWYFFSPRDRKYPNGARPNRAAGSGYWKATGTDKPISSDGCKVGVKKALVFYRGRAPKGLKTSWIMHEYRLADASGASNRLSLRKKGSLRLDDWVLCRIYKKQSSDWKSPAAS

SEQ ID NO: 112 - DNA, 837 bp, Panicum virgatum
  misc_feature (1)..(837): Ceres Clone ID no. 1769201
  misc_feature (1)..(837): Encodes the peptide sequence at SEQ ID NO. 113
attccaacagcttcttcccctcaaagaccactccggcgagattcttcccagaccggccggcgaatcacagctcgatcgatcgttctccggcgagctagcaaccactccctgatcggaatggacttcggaggggcgctgcagctgccgccggggttccggttccacccgacggacgaggagctggtgacgcactacctcctgcgcaagtgcggcgggctggcaccggcggcgccggtgatcgcggaggtggacctgtacaagttcgacccgtggagcctgccggagcgggcggccggcggggagaaggagtggtacttcttctcgccgcgggaccgcaagtaccccaacgggtcgcgccccaaccgcgccgccggcgccgggtactggaaggccaccggcgccgacaagcccgtgggcgcgccgcgccccgtcgccatcaagaaggcgctcgtcttctacgccggcaagccgcccaggggcgtcaagaccaactggatcatgcacgagtaccgcctcgccgacgtcgaccgctccgccgccgcccgcaagaagacggccaataacaacgcgctcaggctggatgactgggtgctgtgccggatctacaacaagaagggcgtgatcgagcggtacgacacggtggacgacgacgaggtcgcggcggccaacgacgtcaagccggccgcgcccaagaacccgcgcggggcggccggcgccggcggcggccgcgcgccgatgaaggtggagatggccgactacggcgggtactacgacgacgggtacgacctcgagacgccgtccgcggggatgctgtgcttcgaccgcccggcggccgtg

SEQ ID NO: 113 - protein, 240 aa, Panicum virgatum
  misc_feature (1)..(240): Ceres Clone ID no. 1769201
  misc_feature (9)..(133): Pfam Name: NAM Pfam Description: No apical meristem (NAM) protein
  misc_feature (1)..(240): Bit score of 343.0 for HMM based on sequences of Figure 4
  misc_feature (1)..(240): Functional Homolog Of SEQ ID NO. 2
MDFGGALQLPPGFRFHPTDEELVTHYLLRKCGGLAPAAPVIAEVDLYKFDPWSLPERAAGGEKEWYFFSPRDRKYPNGSRPNRAAGAGYWKATGADKPVGAPRPVAIKKALVFYAGKPPRGVKTNWIMHEYRLADVDRSAAARKKTANNNALRLDDWVLCRIYNKKGVIERYDTVDDDEVAAANDVKPAAPKNPRGAAGAGGGRAPMKVEMADYGGYYDDGYDLETPSAGMLCFDRPAAV

SEQ ID NO: 114 - DNA, 1395 bp, Glycine max
  misc_feature (1)..(1395): Ceres Clone ID no. 477097
  misc_feature (1)..(1395): Encodes the peptide sequence at SEQ ID NO. 115
aagtttgaagcggcgccaccatagttggtgtagctagcgagggagggatatagggggaagcgtttattcattcattaagatggcatcggagcttcaattgcccccaggcttcagattccatccaacggaccaggagctggtgttgcactatctctgccgtaaatgcgcatcgcagcctatcgccgttcccatcatcgccgaaatcgacctctacaaatacgacccctgggacctacccggattggcttcctacggagagaaagagtggtacttcttttcaccacgggaccggaaatacccgaacggttccaggccgaaccgggcggcgggaaccggttactggaaggcaaccggggcggataagcccattggccaccccaaaccggttgggataaaaaaagctttggtgttttacgcagggaaagctccgaaaggggacaagagcaattggatcatgcacgagtatcgtctcgccgatgtagatcgctccgttcgcaaaaagaacagcctaaggttagatgattgggtgctttgccgtatttacaacaagaagggcacgatcgagaagttccaaccaagcagcgatgttgttgttagccgaaaaatggaatcatcggagatcgaagacaggaagccggagattctgaaaagcggaggaggttgtcttctgccgccggttccgccgccgcaagcgaaggcggcggtgaagaaggattacatgtacttcgacccgtcggattcaatcccgaagctgcacacggactcgagctgttcggagcacgtggtatcgccggaattcgcgagcgaggtgcagagcgagccaaagtggaaggagtgggagaaaagcctcgagtttccgtttaattacgtggatgccactctgaacaacagcaacagcttcacgacgcaattccagggcaataatcagatgatgtcgccgctgcaggacatgttcatgtactggcccaacaagcccttctgaacaaaccgatccacgccgcccattcgcatttgcacggtagcacgagactcaaggtctatgagtgtgcctgtgcgaccacacacagacgattatttatcaagttagcttagctagggcaaagaaagataaaaacattgaagctggaaacgcatgtgtttgttgggtccaccgtctgcaccggttctttttggtgttttgctatgtgacgacgacgacgacgatgacgatccaacggtgcatgtttgttgacctgtccctagtagtagtagcatgtgtacagctattgtatgtagaatgtagataggtacactactacacgttgttgtcatgtgatcatagaagctctcttaccgggaaaaataaaaattgatagaaggatggaaggtgtatttggaccttccctaattaatatt

SEQ ID NO: 115 - protein, 300 aa, Glycine max
  misc_feature (1)..(300): Ceres Clone ID no. 477097
  misc_feature (7)..(131): Pfam Name: NAM Pfam Description: No apical meristem (NAM) protein
  misc_feature (1)..(300): Bit score of 600.8 for HMM based on sequences of Figure 4
  misc_feature (1)..(300): Functional Homolog Of SEQ ID NO. 2
MASELQLPPGFRFHPTDQELVLHYLCRKCASQPIAVPIIAEIDLYKYDPWDLPGLASYGEKEWYFFSPRDRKYPNGSRPNRAAGTGYWKATGADKPIGHPKPVGIKKALVFYAGKAPKGDKSNWIMHEYRLADVDRSVRKKNSLRLDDWVLCRIYNKKGTIEKFQPSSDVVVSRKMESSEIEDRKPEILKSGGGCLLPPVPPPQAKAAVKKDYMYFDPSDSIPKLHTDSSCSEHVVSPEFASEVQSEPKWKEWEKSLEFPFNYVDATLNNSNSFTTQFQGNNQMMSPLQDMFMYWPNKPF

SEQ ID NO: 116 - DNA, 698 bp, Panicum virgatum
  misc_feature (1)..(698): Ceres Clone ID no. 1910025
  misc_feature (1)..(698): Encodes the peptide sequence at SEQ ID NO. 117
gtcgccacggaaacagctcacgggcagcgaggatttatctcccggctgccagccagccgccgttcgaaaccggacacacgaggaggggggagacgcggtctcgtctggagcctgggatcgagagcgcccgatccatcatccatccatcaggctgtttgggggattgattgctcgagttcgagtaggagcaggaggaggaagatggcaatggtgttggcggcggcggcggtggggagcgggcgcagggacgcggaggcggagctcaacctgccgccggggttccggttccaccccaccgacgaggagctcgtggtgcactacctctgccggaaggtggcgcggcagcagctgcccgtgcccatcatcgccgaggtcgacctctacaagttcgatccctgggatctcccagagaaggcgctgttcggccgcaaggagtggtacttcttcacgccgcggggccgcaagtaccccaacggctcgcgccccaaccgcgccgccgggagggggtactggaaggccaccggcgccgacaagcccatcacgcccaagggctgcgccagggcggcgggcatcaagaaggcgctggtgttctactccggcaaggcgccccggggcgtcaagaccgactggatcatgcacgagtaccgcctcgccgacgcggaccgcgccccgggcaagaaggggtcccagaagttgga

SEQ ID NO: 117 - protein, 165 aa, Panicum virgatum
  misc_feature (1)..(165): Ceres Clone ID no. 1910025
  misc_feature (23)..(150): Pfam Name: NAM Pfam Description: No apical meristem (NAM) protein
  misc_feature (1)..(165): Bit score of 252.4 for HMM based on sequences of Figure 4
  misc_feature (1)..(165): Functional Homolog Of SEQ ID NO. 2
MAMVLAAAAVGSGRRDAEAELNLPPGFRFHPTDEELVVHYLCRKVARQQLPVPIIAEVDLYKFDPWDLPEKALFGRKEWYFFTPRGRKYPNGSRPNRAAGRGYWKATGADKPITPKGCARAAGIKKALVFYSGKAPRGVKTDWIMHEYRLADADRAPGKKGSQKL

SEQ ID NO: 118 - DNA, 876 bp, Sorghum bicolor
  misc_feature (1)..(876): Ceres Annot ID no. 8669922
  misc_feature (1)..(876): Encodes the peptide sequence at SEQ ID NO. 119
atgagcggcggcggtcaggatctgcagctgccgccggggttccggttccacccgacggacgaggagctggtgatgcactacctctgccgccgctgcgccggcctgcccatcgccgtccccatcatcgccgagatcgacctctacaagttcgacccatggcagctccccaggatggcgctgtacggcgagaaggagtggtacttcttctccccgcgggaccgcaagtacccgaacgggtcgaggccgaaccgcgccgccgggtccggctactggaaggccaccggcgccgacaagcccgtgggcacgcccaagccgctcgccatcaagaaggcgctcgtcttctacgccggcaaggcgcccaagggcgagaagaccaactggatcatgcacgagtaccgcctcgccgacgtcgaccgctccgcccgcaagaagaacagcctcaggttggatgactgggtcctgtgccgcatctacaacaagaagggcgggctggagaagccgtcggcggtcgccggcggcgaccacaagccgatgttcgcagcggccgcggtgagctccccaccggagcagaagccgttcgtggcggcgccgggcgggcttcccccattcccggacctggcggcgtactacgaccggccgtcggactcgatgccgcggctgcacgcggactccagctgctcggagcaggtgctgtcgccggagcagctggcgtgcgaccgggaggtgcagagccagcccaagatcagcgagtgggagcgcaccttcgcctccgaccccgtcaaccccgccggctccatgctcgaccccgtcgtcggtggccacgccggcgacccgctgctgcaggacatcctcatgtactggggcaagccgttctag

SEQ ID NO: 119 - protein, 291 aa, Sorghum bicolor
  misc_feature (1)..(291): Ceres Annot ID no. 8669922
  misc_feature (10)..(134): Pfam Name: NAM Pfam Description: No apical meristem (NAM) protein
  misc_feature (1)..(291): Bit score of 520.4 for HMM based on sequences of Figure 4
  misc_feature (1)..(291): Functional Homolog Of SEQ ID NO. 2
MSGGGQDLQLPPGFRFHPTDEELVMHYLCRRCAGLPIAVPIIAEIDLYKFDPWQLPRMALYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGLEKPSAVAGGDHKPMFAAAAVSSPPEQKPFVAAPGGLPPFPDLAAYYDRPSDSMPRLHADSSCSEQVLSPEQLACDREVQSQPKISEWERTFASDPVNPAGSMLDPVVGGHAGDPLLQDILMYWGKPF

SEQ ID NO: 120 - protein, 278 aa, Brassica napus
  misc_feature (1)..(278): Public GI ID no. 31322574
  misc_feature (7)..(131): Pfam Name: NAM Pfam Description: No apical meristem (NAM) protein
  misc_feature (1)..(278): Bit score of 439.8 for HMM based on sequences of Figure 4
  misc_feature (1)..(278): Functional Homolog Of SEQ ID NO. 2
MKAGLNLPAGFRFHPTDEELVQFYLCRKCASEEISAPVIAEIDLYKFNPWELPEMSLYGEKEWYFFSPRDRKYPNGSRPNRAAGTGYWKATGADKPIGKPKTLGIKKALVFYAGKAPKGIKTNWIMHEYRLANVDRSASVNKKNNLRLDDWVLCRIYNKKGTMEKYYPADEKPMTVTAASSPFDASDSTYPTLQEDDSSSSGGRVVSPDAREVQSEPKWGEFENAFDASMFGGGSMDLLQSEDFVPQFLYQPSYDFNSWQEDPPEQKPFLNWSFAPQG

SEQ ID NO: 121 - protein, 174 aa, Glycine max
  misc_feature (1)..(174): Public GI ID no. 187940273
  misc_feature (7)..(131): Pfam Name: NAM Pfam Description: No apical meristem (NAM) protein
  misc_feature (1)..(174): Bit score of 325.8 for HMM based on sequences of Figure 4
  misc_feature (1)..(174): Functional Homolog Of SEQ ID NO. 2
MASELQLPPGFRFHPTDQELVLHYLCRKCASQPIAVPIIAEIDLYKYDPWDLPGLASYGEKEWYFFSPRDRKYPNGSRPNRAAGTGYWKATGADKPIGHPKPVGIKKALVFYAGKAPKGDKSNWIMHEYRLADVDRSVRKKNSLRLDDWVLCRIYNKKGTIEKFQPSSDVVVSR

SEQ ID NO: 122 - protein, 253 aa, Arabidopsis thaliana
  misc_feature (1)..(253): Public GI ID no. 15223963
  misc_feature (11)..(134): Pfam Name: NAM Pfam Description: No apical meristem (NAM) protein
  misc_feature (1)..(253): Bit score of 429.0 for HMM based on sequences of Figure 4
  misc_feature (1)..(253): Functional Homolog Of SEQ ID NO. 2
MMKSGADLQFPPGFRFHPTDEELVLMYLCRKCASQPIPAPIITELDLYRYDPWDLPDMALYGEKEWYFFSPRDRKYPNGSRPNRAAGTGYWKATGADKPIGRPKPVGIKKALVFYSGKPPNGEKTNWIMHEYRLADVDRSVRKKNSLRLDDWVLCRIYNKKGVIEKRRSDIEDGLKPVTDTCPPESVARLISGSEQAVSPEFTCSNGRLSNALDFPFNYVDAIADNEIVSRLLGGNQMWSTTLDPLVVRQGTF

SEQ ID NO: 123 - DNA, 880 bp, Gossypium hirsutum
  misc_feature (1)..(880): Ceres Clone ID no. 100038358
  misc_feature (1)..(880): Encodes the peptide sequence at SEQ ID NO. 124
agaccacccggtaccaacagccaacaacacaaagaaggcatatttacagcttttttaaagaggagcttaagaaagttaagtctaaaaaggaagaagagtttaaagagttcagagaatgaagggagagttagagttgccacctggtttcagattccatcctacagatgacgaattggtgaatcattatttgtgtaggaaatgtgcttctcagcctatttctgtgcccatcattgctgagattgatctttacaagtttgatccatggcagcttccagatatggcgttgtatggtgaaaaagagtggtatttcttttctccaagggatcgaaaatacccaaatgggtgtcggccgaacagggcggctggaaccggatattggaaagcgaccggagccgataagcctatcggaaagcccaaggcactgggcataaaaaaagcactcgttttctacgctggtaaagccccacgcggtgtcaaaaccaactggattatgcacgagtatcgcctcgccaatgttgataggtccgccggcaagagaagcaacaacttgaggcttgatgattgggtgttatgtcgaatatacaacaagaaaggaagcatagagaaacattttccgagtgaacaaaaatcgttaagttacccagaaatggaagatgagaaactgggcatcataatgaatggtcaaaacatgcaacaaccgtggtcggtgatggcgatgaagaacgatgcaatacaaacggatggttcggagtcgagttggtcggagcacgtgccgtcaccggaaatcacgtgggagaaagaagtgaaaagtgaagggagatggaatgagcttgatttcgggttggatttcatagatgaagacccgtttgccagtcaagtt

SEQ ID NO: 124 - protein, 255 aa, Gossypium hirsutum
  misc_feature (1)..(255): Ceres Clone ID no. 100038358
  misc_feature (7)..(131): Pfam Name: NAM Pfam Description: No apical meristem (NAM) protein
  misc_feature (1)..(255): Bit score of 451.3 for HMM based on sequences of Figure 4
  misc_feature (1)..(255): Functional Homolog Of SEQ ID NO. 2
MKGELELPPGFRFHPTDDELVNHYLCRKCASQPISVPIIAEIDLYKFDPWQLPDMALYGEKEWYFFSPRDRKYPNGCRPNRAAGTGYWKATGADKPIGKPKALGIKKALVFYAGKAPRGVKTNWIMHEYRLANVDRSAGKRSNNLRLDDWVLCRIYNKKGSIEKHFPSEQKSLSYPEMEDEKLGIIMNGQNMQQPWSVMAMKNDAIQTDGSESSWSEHVPSPEITWEKEVKSEGRWNELDFGLDFIDEDPFASQV

SEQ ID NO: 125 - protein, 305 aa, Citrus sinensis
  misc_feature (1)..(305): Public GI ID no. 148615629
  misc_feature (9)..(132): Pfam Name: NAM Pfam Description: No apical meristem (NAM) protein
  misc_feature (1)..(305): Bit score of 562.3 for HMM based on sequences of Figure 4
  misc_feature (1)..(305): Functional Homolog Of SEQ ID NO. 2
MMKGAELELPPGFRFHPTDEELVNHYLCRKCAGLPISVPIIAEIDLYKYDPWELPEMARYGEKEWYFFSPRDRKYPNGSRPNRAAGSGYWKATGADKPIGKPKTLGIKKALVFYAGKAPKGIKTNWIMHEYRPANVHRSPATKNNLRLDDWVLCRLYDKKGRMEKHYPSDQKSIGFPELEEDRKPNINISRQEVALGMPPHQGSPAPMMNDLLHMDTSDSVPRLQTDSSCSEHVLSPEITCDKEVQSMPKWNDLGNALNDDYNQFNFNYMDTNSFQDDPFGPQVQYQMDQLSPYQDLFMILQKPF

SEQ ID NO: 126 - protein, 333 aa, Vitis vinifera
  misc_feature (1)..(333): Public GI ID no. 225461361
  misc_feature (14)..(139): Pfam Name: NAM Pfam Description: No apical meristem (NAM) protein
  misc_feature (1)..(333): Bit score of 366.7 for HMM based on sequences of Figure 4
  misc_feature (1)..(333): Functional Homolog Of SEQ ID NO. 2
MGVPETDPLSQLSLPPGFRFYPTDEELLVQYLCRKVAGQGFSLEIIGEIDLYKFDPWVLPSKAIFGEKEWYFFSPRDRKYPNGSRPNRVAGSGYWKATGTDKVITTEGRKVGIKKALVFYVGKAPKGTKTNWIMHEYRLLENSRKNGSSKLDDWVLCRIYKKNSNSSKPIAAVLPSKAHSNGSSSSSSSHLDDVLESLPEIDDRFFSPNRMNSLRVSQPDEKVNFHNLGSGNFDWATLAGVSSLQELVSGVQSHAQPPAAVNNSNEMYVPSLPPLIQAEEEVQSGLRTQRVDPVMNQGFFPQNSNAFSQSFSNSLDPFGFRYPTQPSGFGYRQ

SEQ ID NO: 127 - protein, 349 aa, Ricinus communis
  misc_feature (1)..(349): Public GI ID no. 255563837
  misc_feature (57)..(181): Pfam Name: NAM Pfam Description: No apical meristem (NAM) protein
  misc_feature (1)..(349): Bit score of 535.6 for HMM based on sequences of Figure 4
  misc_feature (1)..(349): Functional Homolog Of SEQ ID NO. 2
MPKRHEPTLEWGQGSDGSNDRNYHTSSSELKAATGKREENKQKREKEVEMKGAELDLPAGFRFHPTDDELVNHYLCRKCAGQSISVPIIAEIDLYKHDPWQLPEMALYGEKEWYFFSPRDRKYPNGSRPNRAAGSGYWKATGADKPIGKPKPLGIKKALVFYAGKAPKGIKTNWIMHEYRLANVDRSAGKKTNLRLDDWVLCRVYNKKGSMEKHQPVSDRKLLKYPEAEEDQKPDILIYGDKAISTFGPSIMNDSSNNDLLAHMDTTSDSVPRLHTDSSCSEEHVLSPEKEVQSEPNWNALDSNALDFGFNYLVDGGFQDYDPFASQVQFQMDQLSPLQDMFMFLQKPF

SEQ ID NO: 128 - DNA, 712 bp, Panicum virgatum
  misc_feature (1)..(712): Ceres Clone ID no. 1727754
  misc_feature (1)..(712): Encodes the peptide sequence at SEQ ID NO. 129
attccaacagcttcttccccccaaagaccactccggcgagcttcttcccagaccggccggcgaatcacagctcgatcgatcgttctccggcgagccagcaaccactccctgatcggaattcggaatggacttcggaggggcgctgcagctgccgccggggttccggttccacccgacggacgaggagctggtgacgcactacctcctgcgcaagtgcggcgggctggcgccggcggcgccggtgatcgcggaggtggacctgtacaagttcgacccgtggagcctgccggagcgggcggcgggcggggagaaggagtggtacttcttctcgccgcgggaccgcaagtaccccaacgggtcgcgccccaaccgcgccgccggcgccgggtactggaaggccaccggcgccgacaagcccgtgggcgcgccgcgccccgtcgccatcaagaaggcgctcgtcttctacgccggcaagccgcccaggggcgtcaagaccaactggatcatgcacgagtaccgcctcgccgacgtcgaccgctccgccgccgcccgcaagaagacggccaataacaacaacgcgctcaggctggatgactgggtgctgtgccggatctacaacaagaaaggcgtgatcgagcggtacgacacggtggacgacgacgaggtcgcggcggccaacgacgtcaagccggccgcgcccaagaacccgcgc

SEQ ID NO: 129 - protein, 196 aa, Panicum virgatum
  misc_feature (1)..(196): Ceres Clone ID no. 1727754
  misc_feature (9)..(133): Pfam Name: NAM Pfam Description: No apical meristem (NAM) protein
  misc_feature (1)..(196): Bit score of 289.0 for HMM based on sequences of Figure 4
  misc_feature (1)..(196): Functional Homolog Of SEQ ID NO. 2
MDFGGALQLPPGFRFHPTDEELVTHYLLRKCGGLAPAAPVIAEVDLYKFDPWSLPERAAGGEKEWYFFSPRDRKYPNGSRPNRAAGAGYWKATGADKPVGAPRPVAIKKALVFYAGKPPRGVKTNWIMHEYRLADVDRSAAARKKTANNNNALRLDDWVLCRIYNKKGVIERYDTVDDDEVAAANDVKPAAPKNPR

SEQ ID NO: 130 - DNA, 1234 bp, Gossypium hirsutum
  misc_feature (1)..(1234): Ceres Clone ID no. 1808216
  misc_feature (1)..(1234): Encodes the peptide sequence at SEQ ID NO. 131
aaagtttcaagcgccgtcgccacataaaagataggagagaggagaggaaaaaaaaaaggggtcaggtatacctgaaaggttaaaaacgtcagaaaaaaaaatgactgcaacggagttacagttacggttacccgctggctttcggttccatccaacggatgaggaactggtgatgcactatctctgccgtaaatgtgcgtctcagtctatcgccgtccctattatcgccgaactcgatctttacaaatacgatccttgggatcttcctgatttggcgttgtacggtgagaaagagtggtatttcttttcaccgagagacaggaaatatccgaacggttcaaggccgaaccgtgcggccgggtctgggtactggaaggcaaccggagctgataagccgattgggcaaccgaaaccggtcggtattaaaaaggctttggtgttttactccgggaaagctccgaaaggagagaaaactaattggattatgcatgagtatcgattagccgacgtggaccggtcggttcgcaagaagaacagcctaaggttggacgattgggtgctgtgccggatttacaataagaaaggttgcatcgaaaaacaacctccgcgaggaagcgttacgaaaaaagctagcgtgacggagattgaggagagtaagccggataatgggacactaggcgtggaggcgtgtgaatttccgccggcagcgacggcggtgggtaacgattacgtatatttcgactcgtcggagtcggtcccgagggttcacacggactcgagctgttcggaacatgcggtgtctcgggaattcatgactgaggttcaaagcgttcccaaatggaaggaagaattgggaatggccaacaataatgccctggatttcgcttataattacttggataccaatatggatatcggatttgcttcacagatgcagagtagtaatcagctgtcgccataccaggatatatttatgtacctgcagaagccattttagaggagaaaataaatttgggcgttgcaattgaagggatactgtgttttggcgtatcgctgggtaacacgagactgaaagtccatgagtgtaccggtgggcgtgcgcgtagataaaaagaagctgcttaaactttgaaattggtagatagaacgggaaagccggggggaggttgttgattatttgtttatataaaatcagagagctaaaatttgatgattaaaatatattttagatttt

SEQ ID NO: 131 - protein, 298 aa, Gossypium hirsutum
  misc_feature (1)..(298): Ceres Clone ID no. 1808216
  misc_feature (10)..(134): Pfam Name: NAM Pfam Description: No apical meristem (NAM) protein
  misc_feature (1)..(298): Bit score of 575.3 for HMM based on sequences of Figure 4
  misc_feature (1)..(298): Functional Homolog Of SEQ ID NO. 2
MTATELQLRLPAGFRFHPTDEELVMHYLCRKCASQSIAVPIIAELDLYKYDPWDLPDLALYGEKEWYFFSPRDRKYPNGSRPNRAAGSGYWKATGADKPIGQPKPVGIKKALVFYSGKAPKGEKTNWIMHEYRLADVDRSVRKKNSLRLDDWVLCRIYNKKGCIEKQPPRGSVTKKASVTEIEESKPDNGTLGVEACEFPPAATAVGNDYVYFDSSESVPRVHTDSSCSEHAVSREFMTEVQSVPKWKEELGMANNNALDFAYNYLDTNMDIGFASQMQSSNQLSPYQDIFMYLQKPF

SEQ ID NO: 132 - protein, 260 aa, Arachis hypogaea
  misc_feature (1)..(260): Public GI ID no. 195549534
  misc_feature (7)..(131): Pfam Name: NAM Pfam Description: No apical meristem (NAM) protein
  misc_feature (1)..(260): Bit score of 454.8 for HMM based on sequences of Figure 4
  misc_feature (1)..(260): Functional Homolog Of SEQ ID NO. 2
MKSELELPPGFRFHPTDEELVNHYLCKKCASQSIAVPIIKEIDLYKFDPWHLPEMALYGEKEWYFFSPRDRKYPNGSRPNRAAGSGYWKATGADKPIGKPKALAIKKALVFYAGKAPKGVKTNWIMHEYRLANVDRSAGNKKNNLRLDDWVLCRIYNKKGKIEKYNHLGAADHKSASSEEENERKPEVKERLHMDTSSDSVVSADVTWESREVQSEPKWNDLLDQVFDFQLGSFVDFSSAGDDPFAPQLSPWHQDTFITF

SEQ ID NO: 133 - DNA, 1029 bp, Populus trichocarpa
  misc_feature (1)..(1029): Ceres Annot ID no. 1466775
  misc_feature (1)..(1029): Encodes the peptide sequence at SEQ ID NO. 134
atgggactgcaagaaacagaccctctagcccaattgagcttgccaccgggatttcggtttcacccgactgatgaagagcttttggtgcaatacttgtgtaagaaggttgctggtcaccatttctccttgcaaatcattggcgaaattgatttgtacaagtttgatccgtggttcttaccaggtaaggcaatatttggtgaaaaagaatggtattttttcagtccgagagaccgcaagtaccccaatggatcccgacccaacagggttgccgggtctgggtattggaaggccaccggtactgacaaagtaatcacgacagagggacgtaaagttggcatcaagaaagctttggtcttttacgttggcaaagccccaaaaggcaccaaaactaattggatcatgcatgaatatcgccttcttgaatcctctcgcaaaagtggaagtacaaagttggatgaatgggtattgtgtcggatttacaagaagaattcaagtgctgcacagaaatccatgtcaagcgtttcaagcaaagaatacagtactaatggttcatgttcatcatcctcttctcatttggaagatgtccttgactcattgacagagattgatgaccggctctttgctttgcctcgaaccaactcactcaaacaaatgcaacacgaagagaaaatcaacttagcaaatctgggttcagggagctttgactgggcgacacttgctgggctcaactcgttgcctgaactcctacaaactcagcctggtgcgaattactcgaataccaatgtcaatggtgtgcatgtcccttcaatgcccccactctgccacgcggattcatcaacagggaggatggggacctcggttgaagaggaggtccaaagtggggttagaactcagctgcgagatggcaactcgggggcttttcaacaaaactcgggcgtgatgacaccgaacttctcttctaccttactcgacccatatgagctaaggtattcgacccaaccgggaagtgggtatgggtttaggcagtga

SEQ ID NO: 134 - protein, 342 aa, Populus trichocarpa
  misc_feature (1)..(342): Ceres Annot ID no. 1466775
  misc_feature (14)..(139): Pfam Name: NAM Pfam Description: No apical meristem (NAM) protein
  misc_feature (1)..(342): Bit score of 366.0 for HMM based on sequences of Figure 4
  misc_feature (1)..(342): Functional Homolog Of SEQ ID NO. 2
MGLQETDPLAQLSLPPGFRFHPTDEELLVQYLCKKVAGHHFSLQIIGEIDLYKFDPWFLPGKAIFGEKEWYFFSPRDRKYPNGSRPNRVAGSGYWKATGTDKVITTEGRKVGIKKALVFYVGKAPKGTKTNWIMHEYRLLESSRKSGSTKLDEWVLCRIYKKNSSAAQKSMSSVSSKEYSTNGSCSSSSSHLEDVLDSLTEIDDRLFALPRTNSLKQMQHEEKINLANLGSGSFDWATLAGLNSLPELLQTQPGANYSNTNVNGVHVPSMPPLCHADSSTGRMGTSVEEEVQSGVRTQLRDGNSGAFQQNSGVMTPNFSSTLLDPYELRYSTQPGSGYGFRQ

SEQ ID NO: 135 - DNA, 1168 bp, Arabidopsis thaliana
  misc_feature (1)..(1168): Ceres Clone ID no. 23342
  misc_feature (1)..(1168): Encodes the peptide sequence at SEQ ID NO. 136
agattacaatcttgagcagacgaagaaaacccaaaaaaaatccagatccagctgaaattgaattttcaaccaacgaagaagagatttttccaagagcaacagacaagaagaagagaatgaagtcggagctaaatttaccagctgggttccgattccatccaacggacgaggagcttgtgaaattctacttgtgccggaaatgtgcttccgagcagatctcggctccggttatcgccgagattgatctctacaagttcaatccttgggagcttccagagatgtctctgtacggagagaaagagtggtacttcttctcacctagagatcggaaatacccaaacggttcgcgtcctaaccgggcagcaggaaccggttattggaaagctaccggagcagataaaccgattggtaaaccgaagacgttgggtatcaagaaagcactcgtcttctacgcagggaaagctccaaaagggattaagaccaattggataatgcatgagtatcgtctcgctaatgttgatagatcagcttctgttaacaaaaagaacaacctacgacttgatgattgggttttatgtcgaatatacaacaagaaaggaaccatggagaagtatttccccgcggatgagaagccgaggaccacgacaatggctgaacagtcatcatcaccttttgatacatcagactcgacttacccgacattgcaagaggatgattccagcagctcaggtggtcacggtcacgtggtgtcaccggatgttttggaggttcagagcgagcctaaatggggagagcttgaggatgctttggaagcttttgatacttcaatgtttggtagttccatggagttgttgcagcctgacgcttttgtccctcagttcttgtatcagtctgattatttcacttccttccaggatccgcctgagcagaaaccattcttgaattggagttttgctccacaggggtaaaaacggaagagaccaaaaaaggtgtttgctagtagtactgtgatgtgccagagagaagagtctcatctcaactcatccctggctcttagtagtaaaagaagattgtagaatgttaatagcttttagcatcaatgtctcattagcaggcacattcttgttctttcatgagaagtttatatgaaaactaaaaatttatattc

SEQ ID NO: 136 - protein, 283 aa, Arabidopsis thaliana
  misc_feature (1)..(283): Ceres Clone ID no. 23342
  misc_feature (7)..(131): Pfam Name: NAM Pfam Description: No apical meristem (NAM) protein
  misc_feature (1)..(283): Bit score of 470.0 for HMM based on sequences of Figure 4
  misc_feature (1)..(283): Functional Homolog Of SEQ ID NO. 2
MKSELNLPAGFRFHPTDEELVKFYLCRKCASEQISAPVIAEIDLYKFNPWELPEMSLYGEKEWYFFSPRDRKYPNGSRPNRAAGTGYWKATGADKPIGKPKTLGIKKALVFYAGKAPKGIKTNWIMHEYRLANVDRSASVNKKNNLRLDDWVLCRIYNKKGTMEKYFPADEKPRTTTMAEQSSSPFDTSDSTYPTLQEDDSSSSGGHGHVVSPDVLEVQSEPKWGELEDALEAFDTSMFGSSMELLQPDAFVPQFLYQSDYFTSFQDPPEQKPFLNWSFAPQG

SEQ ID NO: 137 - protein, 349 aa, Arachis hypogaea
  misc_feature (1)..(349): Public GI ID no. 209171097
  misc_feature (14)..(139): Pfam Name: NAM Pfam Description: No apical meristem (NAM) protein
  misc_feature (1)..(349): Bit score of 371.5 for HMM based on sequences of Figure 4
  misc_feature (1)..(349): Functional Homolog Of SEQ ID NO. 2
MGIQEKDPLSQLSLPPGFRFYPTDEELLVQYLCRKVAGHHFSLEIIGEIDLYKFDPWVLPSKAIFGEKEWYFFSPRDRKYPNGSRPNRVAGSGYWKATGTDKTITTEGRKVGIKEALVFYIGKAPKGTKTNWIMHEYRLLDSTRKNGSTKLDDWVLCRIYKKNSSAQQKVPNGVVSSSEQYATQYSNGSSSNSSSSHLDEVLESLPEIDDRCFALPRVNSLRALQQQRHHQEDTKVGLLQQQQQQGLVAGTGSFLDWASGPGILNDLGQAQQGIVNYGNDLFVPSVCHVDSNLVPAKIEEEVQSGVKTQSAFFQQGPNPNDFTQAFSNQLDPYGFSRYSVQPVGFGFRQ

SEQ ID NO: 138 - protein, 304 aa, Hordeum vulgare
  misc_feature (1)..(304): Public GI ID no. 138753442
  misc_feature (1)..(304): Hordeum vulgare subsp. vulgare
  misc_feature (9)..(133): Pfam Name: NAM Pfam Description: No apical meristem (NAM) protein
  misc_feature (1)..(304): Bit score of 493.3 for HMM based on sequences of Figure 4
  misc_feature (1)..(304): Functional Homolog Of SEQ ID NO. 2
MSGGQELNLPPGFRFHPTDEELVMHYLCRRCAGAPIAVPIITEIDLYKLDPWQLPKMAMYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGMEKPASVDRKPVTMGGYGVGPGAMASSPQEQKPVMGMNANGGGSGGVQPFPDFAAYYDRPSDSMPRLHADSRCSEQVLSPDFPGERGGGEVQSQPKISELERSFASGGDPVNPAAGSILEPHGGFGGDPLLQDILMYWGKPF

SEQ ID NO: 139 - DNA, 585 bp, Brassica napus
  misc_feature (1)..(585): Ceres Clone ID no. 1431867
  misc_feature (1)..(585): Encodes the peptide sequence at SEQ ID NO. 140
gattacaatcgccgattaaaaaccaacaaaatgaaggcggagctaaatttaccggcgggattccgatttcacccgacggacgaggagctagtgaagttctatctctgccggagatgcgcgtcggagccgatcaccgttccggtgatcgcggagattgatctgtacaagttcaatccatgggagcttccagacaaggcgttgtacggagagaaagaatggtacttcttctcacaccgagaccggaaatacccaaacggttcgcgtccaaaccgggcagctggaaccggttattggaaagcgactggagctgataaaccgatcggtaaaccgaagacgttggggattaagaaagcgctcgtcttctacgcagggaaagctccgagaggagtgaagacgaattggattatgcacgagtatcgtctcgctaatgttgaccggtccgcttcttcgaacaagaagaacaacttaagacttgatgattgggtgttatgtcggatttacaataagaaaggaacggtggagaagtattatccggcggatgagaaagagagggtgatgatgatgactactaatactactacgacg

SEQ ID NO: 140 - protein, 185 aa, Brassica napus
  misc_feature (1)..(185): Ceres Clone ID no. 1431867
  misc_feature (7)..(131): Pfam Name: NAM Pfam Description: No apical meristem (NAM) protein
  misc_feature (1)..(185): Bit score of 326.3 for HMM based on sequences of Figure 4
  misc_feature (1)..(185): Functional Homolog Of SEQ ID NO. 2
MKAELNLPAGFRFHPTDEELVKFYLCRRCASEPITVPVIAEIDLYKFNPWELPDKALYGEKEWYFFSHRDRKYPNGSRPNRAAGTGYWKATGADKPIGKPKTLGIKKALVFYAGKAPRGVKTNWIMHEYRLANVDRSASSNKKNNLRLDDWVLCRIYNKKGTVEKYYPADEKERVMMMTTNTTTT

SEQ ID NO: 141 - DNA, 1042 bp, Arabidopsis thaliana
  misc_feature (1)..(1042): Ceres Clone ID no. 36478
  misc_feature (1)..(1042): Encodes the peptide sequence at SEQ ID NO. 142
aaaacatatctttacagttctttcttgctaaacaacaataaaggggaaaataggttaattatgatgaaatctggggctgatttgcaatttccaccaggatttagatttcatcctacggatgaggagctagtcctcatgtatctctgtcgtaattgcgcgtcgcagccgatccctgctccgattatcaccgaactcgatttgtaccgatatgatccttgggaccttcccgacatggctttgtacggtgaaaaggagtggtattttttctcaccaagagatcgaaagtatccaaacggttcaagacccaaccgtgcagctggtactggatattggaaagctaccggagctgataaaccaataggtcgtcctaaaccggttggtattaagaaggctctagtgttttactcgggaaaacctccaaatggagagaaaaccaattggattatgcacgaataccggctcgctgacgttgaccggtcggttcttaagaaaaacagtctaagattggacgattgggtattgtgtcgtatatataacaagaaaggtgtcatcgagaagcgacgaagcgatatcgaggacgggttaaagcctgtgactgacacgtgtccaccggaatctgtggcgagattgatctccggctcggagcaagcggtgtcaccggaattcacgtgtagcaacggtcggttgagtaatgcccttgattttccgtttaattacgtagatgccatcgccgataacgagattgtgtcacggctattgggcgggaatcagatgtggtcgacgacgcttgatccacttgtggttaggcagggaactttctgagttgtcacgtgcgattagagttagtggaaagtggaaactatcactgtctgttttcgcacgtgtcgggtagccgtcttgaaacccgctagctggtccagaagtgacctcattgggcttttcaacaacaattgggccttagcctttcttctcccttagtaagacaagctactgtattgtgttgttattttcaggaagcaatataaattcattttaatcactc

SEQ ID NO: 142 - protein, 253 aa, Arabidopsis thaliana
  misc_feature (1)..(253): Ceres Clone ID no. 36478
  misc_feature (11)..(134): Pfam Name: NAM Pfam Description: No apical meristem (NAM) protein
  misc_feature (1)..(253): Bit score of 422.0 for HMM based on sequences of Figure 4
  misc_feature (1)..(253): Functional Homolog Of SEQ ID NO. 2
MMKSGADLQFPPGFRFHPTDEELVLMYLCRNCASQPIPAPIITELDLYRYDPWDLPDMALYGEKEWYFFSPRDRKYPNGSRPNRAAGTGYWKATGADKPIGRPKPVGIKKALVFYSGKPPNGEKTNWIMHEYRLADVDRSVLKKNSLRLDDWVLCRIYNKKGVIEKRRSDIEDGLKPVTDTCPPESVARLISGSEQAVSPEFTCSNGRLSNALDFPFNYVDAIADNEIVSRLLGGNQMWSTTLDPLVVRQGTF

SEQ ID NO: 143 - DNA, 746 bp, Panicum virgatum
  misc_feature (1)..(746): Ceres Clone ID no. 1864096
  misc_feature (1)..(746): Encodes the peptide sequence at SEQ ID NO. 144
aagccctcctcccctcttcctaccattagcagaagagaagaagagcagagacaggcaggctgcaaagcagcagcagcgaagcgcgatcgagagagagacacgatgagcggcggcggccaggacctgcatctgccgccggggttccggttccacccgacggacgaggagctggtgatgcactacctctgccgccgctgcgccgggctgcccatcgccgtccccatcgtcgccgagatcgacctctacaagttcgacccatggcagctccccagaatggcgctgtacggcgagaaggagtggtacttcttctccccgcgggaccgcaagtacccgaacgggtcgcggccgaaccgcgccgccgggtccgggtactggaaggccaccggcgccgacaagcccgtgggcacgcccaagcccctcgccatcaagaaggcgctagtcttctacgccggcaaggcgcccaagggcgagaagaccaactggatcatgcacgagtaccgcctcgccgacgtcgaccgcaccgcccgcaagaagaacagcctcaggctggatgactgggtcctgtgccgcatctacaacaagaagggcgggctggagaagccgccagtggccgccggcgaccgcaagccggcgctcgccgcggcggcgggctccccgccggagcagaagccgttcgtggcggcgccgggcgggctccccccccgcgtcgcggacctggcggcgtactacgaccggccgtcggactc

SEQ ID NO: 144 - protein, 214 aa, Panicum virgatum
  misc_feature (1)..(214): Ceres Clone ID no. 1864096
  misc_feature (10)..(134): Pfam Name: NAM Pfam Description: No apical meristem (NAM) protein
  misc_feature (1)..(214): Bit score of 361.1 for HMM based on sequences of Figure 4
  misc_feature (1)..(214): Functional Homolog Of SEQ ID NO. 2
MSGGGQDLHLPPGFRFHPTDEELVMHYLCRRCAGLPIAVPIVAEIDLYKFDPWQLPRMALYGEKEWYFFSPRDRKYPNGSRPNRAAGSGYWKATGADKPVGTPKPLAIKKALVFYAGKAPKGEKTNWIMHEYRLADVDRTARKKNSLRLDDWVLCRIYNKKGGLEKPPVAAGDRKPALAAAAGSPPEQKPFVAAPGGLPPRVADLAAYYDRPSD

SEQ ID NO: 145 - DNA, 840 bp, Populus trichocarpa
  misc_feature (1)..(840): Ceres Annot ID no. 1452119
  misc_feature (1)..(840): Encodes the peptide sequence at SEQ ID NO. 146
atgacagcggcgacactagagttaccaccaggtttcaggttccatccaacggatgaggagctcgtgctgcactatctctgccgtaaatgctcatcgcagcccattgctgttcctattattgctgaagttgatctctacaagtttgacccatgggatctccctggtatggccttgtacggagaaaaggaatggtacttttttacgccgagggacaggaagtaccctaacggatcgagaccgaatcgtgctgcagggaggggctactggaaagccacgggagccgacaagccgatcgggcagccaaagacagctgggatcaagaaagctttggtattttacgcaggaaaagctcccaagggagagaaaacgaactggattatgcacgagtatcgcctagccgaggtggatcgctccgttcgcaagaagaacagcttaaggctggacgattgggtactctgtcgcatacacaacaagaaaggcacaattgagaagcaagggcagcatcttagcgtccagaaagcgaattcgtcgacggagattgccgaggaggatgagaagaagtcggtggttatgctgccgccaccaccaggcccgtcctcggcgacaggaacggtgaatgattacgtctatttcgacacgtcagattctgtgccgaggctgcacacagattcgagctgctcggagcatgtggtgtcgccagaattcacgtgcgaggtgcagagcaatccttataattacttggatgccaccatggatattccgttcgcgtctcaatttcaggggaatcatcagatgtcgccgcttcaggacatgttcatgtatctgcagaagccgttttga

SEQ ID NO: 146 - protein, 279 aa, Populus trichocarpa
  misc_feature (1)..(279): Ceres Annot ID no. 1452119
  misc_feature (8)..(132): Pfam Name: NAM Pfam Description: No apical meristem (NAM) protein
  misc_feature (1)..(279): Bit score of 558.1 for HMM based on sequences of Figure 4
  misc_feature (1)..(279): Functional Homolog Of SEQ ID NO. 2
MTAATLELPPGFRFHPTDEELVLHYLCRKCSSQPIAVPIIAEVDLYKFDPWDLPGMALYGEKEWYFFTPRDRKYPNGSRPNRAAGRGYWKATGADKPIGQPKTAGIKKALVFYAGKAPKGEKTNWIMHEYRLAEVDRSVRKKNSLRLDDWVLCRIHNKKGTIEKQGQHLSVQKANSSTEIAEEDEKKSVVMLPPPPGPSSATGTVNDYVYFDTSDSVPRLHTDSSCSEHVVSPEFTCEVQSNPYNYLDATMDIPFASQFQGNHQMSPLQDMFMYLQKPF

SEQ ID NO: 147 - protein, 297 aa, Selaginella moellendorffii
  misc_feature (1)..(297): Public GI ID no. 302774106
  misc_feature (18)..(143): Pfam Name: NAM Pfam Description: No apical meristem (NAM) protein
  misc_feature (1)..(297): Bit score of 354.4 for HMM based on sequences of Figure 4
  misc_feature (1)..(297): Functional Homolog Of SEQ ID NO. 2
MDSGGKPRTAPPSEQLNLPAGFRFHPTDEELVVSYLAIKAESRPFAIPIIAEIDLYKFDPWELPEKALFGEREWYFFSPRDRKYPNGARPNRAAASGYWKATGTDKPILSKGKKVGVKKALVFYKGKAPKGSKTNWIMHEYRLADSSAKAAAAIPAMRKKGSLRLDDWVLCRIYKKSSGAFKPMLSGSTTPRSSMKSEPPEEELDDVLASLPDIDDNSRLYKIPPFGSSSPPPPPRRGRAWNSRTRTTSGVRADRPSRGPSRDLPTICPPRCSTRDLLARRRPSHFLLGERSVENRC

SEQ ID NO: 148 - protein, 296 aa, Bruguiera gymnorhiza
  misc_feature (1)..(296): Public GI ID no. 171452372
  misc_feature (8)..(132): Pfam Name: NAM Pfam Description: No apical meristem (NAM) protein
  misc_feature (1)..(296): Bit score of 558.3 for HMM based on sequences of Figure 4
  misc_feature (1)..(296): Functional Homolog Of SEQ ID NO. 2
MKGAEIELPPGFRFHPTDEELVNHYLLRKCGGQPIAVPIIAEIDLYKFDPWQLPEKAVSGEKEWYFFSPRDRKYPNGSRPNRAAGTGYWKATGADKPIGRPKPLGIKKALVFYAGKAPRGIKTNWIMHEYRLANVDRSAGKTKNLRLDDWVLCRIYNKKGSIEKYSVDRKLNYSETEDQKPDISMASQNGMALPQRSPLAPSSMMSSDLLHVDTSDSIPRLHTDSSCSEHVLSPEVTCEKEVQSEPKWNADLENSFDFNLGYMDAFQDDPFASQVQYQMDYLSPSQEMFMYWQKPL

SEQ ID NO: 149 - protein, 283 aa, Arabidopsis lyrata
  misc_feature (1)..(283): Public GI ID no. 297810999
  misc_feature (1)..(283): Arabidopsis lyrata subsp. lyrata
  misc_feature (7)..(131): Pfam Name: NAM Pfam Description: No apical meristem (NAM) protein
  misc_feature (1)..(283): Bit score of 467.0 for HMM based on sequences of Figure 4
  misc_feature (1)..(283): Functional Homolog Of SEQ ID NO. 2
MKAELNLPAGFRFHPTDEELVKFYLCRKCASEQISAPVIAEIDLYKFNPWELPDMSLYGEKEWYFFSPRDRKYPNGSRPNRAAGTGYWKATGADKPIGKPKTLGIKKALVFYAGKAPKGIKTNWIMHEYRLANVDRSASVNKKNNLRLDDWVLCRIYNKKGTMEKYFPADEKPRTTTVAEQSSSPFDTSDSTYPTLQEDDSSSSGGHGHVVSPDVLEVQSEPKWGELEDALEAFDTSMFGGSMELLQPDAFVPQFLYQSDYFTSFQDPPEQKPFLNWSFAPQG

SEQ ID NO: 150 - protein, 252 aa, Arabidopsis thaliana
  misc_feature (1)..(252): Public GI ID no. 21593134
  misc_feature (10)..(133): Pfam Name: NAM Pfam Description: No apical meristem (NAM) protein
  misc_feature (1)..(252): Bit score of 421.9 for HMM based on sequences of Figure 4
  misc_feature (1)..(252): Functional Homolog Of SEQ ID NO. 2
MKSGADLQFPPGFRFHPTDEELVLMYLCRNCASQPIPAPIITELDLYRYDPWDLPDMALYGEKEWYFFSPRDRKYPNGSRPNRAAGTGYWKATGADKPIGRPKPVGIKKALVFYSGKPPNGEKTNWIMHEYRLADVDRSVLKKNSLRLDDWVLCRIYNKKGVIEKRRSDIEDGLKPVTDTCPPESVARLISGSEQAVSPEFTCSNGRLSNALDFPFNYVDAIADNEIVSRLLGGNQMWSTTLDPLVVRQGTF

SEQ ID NO: 151 - protein, 303 aa, Oryza sativa
  misc_feature (1)..(303): Public GI ID no. 125572883
  misc_feature (1)..(303): Oryza sativa Japonica Group
  misc_feature (9)..(133): Pfam Name: NAM Pfam Description: No apical meristem (NAM) protein
  misc_feature (1)..(303): Bit score of 518.4 for HMM based on sequences of Figure 4
  misc_feature (1)..(303): Functional Homolog Of SEQ ID NO. 2
MSGGQDLQLPPGFRFHPTDEELVMHYLCRRCAGLPIAVPIIAEIDLYKFDPWQLPRMALYGEKEWYFFSPRDRKYPNGSRPNRAAGSGYWKATGADKPVGSPKPVAIKKALVFYAGKAPKGEKTNWIMHEYRLADVDRSARKKNSLRLDDWVLCRIYNKKGGLEKPPAAAVAAAGMVSSGGGVQRKPMVGVNAAVSSPPEQKPVVAGPAFPDLAAYYDRPSDSMPRLHADSSCSEQVLSPEFACEVQSQPKISEWERTFATVGPINPAASILDPAGSGGLGGLGGGGRDPLLQEILMYWGKPF

SEQ ID NO: 152 - protein, 291 aa, Cicer arietinum
  misc_feature (1)..(291): Public GI ID no. 242877145
  misc_feature (7)..(131): Pfam Name: NAM Pfam Description: No apical meristem (NAM) protein
  misc_feature (1)..(291): Bit score of 599.5 for HMM based on sequences of Figure 4
  misc_feature (1)..(291): Functional Homolog Of SEQ ID NO. 2
MASELQLPPGFRFHPTDEELVMHYLCRKCTSQPISVPIIAEIDLYKYDPWDLPGMASYGEKEWYFFSPRDRKYPNGSRPNRAAGSGYWKATGADKPIGHPKPVGIKKALVFYAGKAPKGDKTNWIMHEYRLADVDRSIRRKNSLRLDDWVLCRIYNKKGTIEKQPNSGVINRKTDPSEIEDKKPEILTRGSGLPPHPPPQATAGMRDYMYFDTSDSIPKLHTDSSCSEHVVSPEFASEVQSEPKWNEWEKHLEFPYNYVDTTLNSGFGSQFQSNNQMSPLQDMFMYLPKTF

SEQ ID NO: 153 - protein, 303 aa, Oryza sativa
  misc_feature (1)..(303): Public GI ID no. 125528621
  misc_feature (1)..(303): Oryza sativa Indica Group
  misc_feature (9)..(133): Pfam Name: NAM Pfam Description: No apical meristem (NAM) protein
  misc_feature (1)..(303): Bit score of 519.3 for HMM based on sequences of Figure 4
  misc_feature (1)..(303): Functional Homolog Of SEQ ID NO. 2
MSGGQDLQLPPGFRFHPTDEELVMHYLCRRCAGLPIAVPIIAEIDLYKFDPWQLPRMALYGEKEWYFFSPRDRKYPNGSRPNRAAGSGYWKATGADKPVGSPKPVAIKKALVFYAGKAPKGEKTNWIMHEYRLADVDRSARKKNSLRLDDWVLCRIYNKKGGLEKPPAAAVAAAGMVSNGGGVERKPMVGVNAAVSSPPEQKPVVAGPAFPDLAAYYDRPSDSMPRLHADSSCSEQVLSPEFACEVQSQPKISEWERTFATVGPINPAASILDPAGSGGLGGLGGGGSDPLLQDILMYWGKPF

SEQ ID NO: 154 - protein, 303 aa, Oryza sativa
  misc_feature (1)..(303): Public GI ID no. 115441473
  misc_feature (1)..(303): Oryza sativa Japonica Group
  misc_feature (9)..(133): Pfam Name: NAM Pfam Description: No apical meristem (NAM) protein
  misc_feature (1)..(303): Bit score of 520.5 for HMM based on sequences of Figure 4
  misc_feature (1)..(303): Functional Homolog Of SEQ ID NO. 2
MSGGQDLQLPPGFRFHPTDEELVMHYLCRRCAGLPIAVPIIAEIDLYKFDPWQLPRMALYGEKEWYFFSPRDRKYPNGSRPNRAAGSGYWKATGADKPVGSPKPVAIKKALVFYAGKAPKGEKTNWIMHEYRLADVDRSARKKNSLRLDDWVLCRIYNKKGGLEKPPAAAVAAAGMVSSGGGVQRKPMVGVNAAVSSPPEQKPVVAGPAFPDLAAYYDRPSDSMPRLHADSSCSEQVLSPEFACEVQSQPKISEWERTFATVGPINPAASILDPAGSGGLGGLGGGGSDPLLQDILMYWGKPF

SEQ ID NO: 155 - protein, 252 aa, Brassica napus
  misc_feature (1)..(252): Public GI ID no. 31322566
  misc_feature (7)..(131): Pfam Name: NAM Pfam Description: No apical meristem (NAM) protein
  misc_feature (1)..(252): Bit score of 412.1 for HMM based on sequences of Figure 4
  misc_feature (1)..(252): Functional Homolog Of SEQ ID NO. 2
MKAELNLPEGFRFHPTDEELVKFYLCRRCASEPISVPVIAEIDLYKFNPWELPEMALYGEKEWYFFSPRDRKYPNGSRPNRSAGTGYWKATGADKPIGKPKTLGIKKALVFYAGKAPRGVKTNWIMHEYRLANGDRSASFNKKNSLRLDDWGLCRIYHKKGTMEKCYPAVVTTTSTSDSKCSSHVISPDVVTCSDNCESKWVDDLKDEFMFGSTLQNDSFVPQFLYQSEFATPYEDPQEQKPFLNWSFGHQG

SEQ ID NO: 156 - protein, 343 aa, Populus trichocarpa
  misc_feature (1)..(343): Public GI ID no. 224128213
  misc_feature (14)..(139): Pfam Name: NAM Pfam Description: No apical meristem (NAM) protein
  misc_feature (1)..(343): Bit score of 383.2 for HMM based on sequences of Figure 4
  misc_feature (1)..(343): Functional Homolog Of SEQ ID NO. 2
MGVQETDPLAQLSLPPGFRFHPTDEELLVQYLCRKVAGHHFSMQIIGEIDLYKFDPWLLPSKAIFGEKEWYFFSPRDRKYPNGSRPNRVAGSGYWKATGTDKIITSDGRKVGIKKALVFYIGKAPKGTKTNWIMHEYRLIESSRKHGSTKLDEWVLCRIYKKKSIAAQKSMSGVSSKEPSTNSPSSSFSSHFDDDVLDPLPEIDDRFLDLPRTNSLKPRQHEEKINLATLGSGSFDWATLAGLNSVPQLVQTQPCVSYSNSNVHDVYVPSMSQLCHMDTSAERMENLVEEEVQSGVRTRLDSVGNPVFFQQNSSVRPQSFSNSFDPYGLRHSIQPGSGFGFNQ

SEQ ID NO: 157 - DNA, 1640 bp, Glycine max
  misc_feature (1)..(1640): Ceres Clone ID no. 481915
  misc_feature (1)..(1640): Encodes the peptide sequence at SEQ ID NO. 158
aattaaaaaaagagaaaagcaactagagaaaaaaaaaaaagagaagaaaaaaaaacttggttttatcttctttgttattattatattcacttcttcaatatcttggttctttgatattattattcgattgagcaaaaaatgggagttccagagagagaccctcttgcacaattgagcttgcctcctggatttagattttatcccactgatgaggagcttttggttcagtacctttgccgcaaggttgctggccatcatttctctcttccaatcattgctgaagttgatttgtacaagtttgatccatgggttcttccaggtaaggcagcgtttggagagaaggagtggtacttcttcagtccaagagacaggaagtacccgaatggttcacgaccaaacagagttgcgggttctgggtattggaaagccactggaactgacaaaatcatcaccactgaaggtagaaaagttggcataaaaaaagcacttgttttctacgttggcaaagcacccaaaggctccaaaaccaattggatcatgcacgagtatcgccttctcgactcttcccgcaaacacaacctcggaaccgcaaagcttgatgattgggttctgtgtcgtatctataagaagaactcaagtgcgcaaaaggttgaggcaaatcttttggctatggaatgtagcaatgggtcatcaccttcttcatcgtcccacgtggacgacatgctggaatcgttgccggagatcgatgatcggtgcttcaccctgccgcgagtgaactcagtcagaacaatgcagcagcaggacgagaaattcggatttcagaacatgggatccgggtttttcaccgattgggtcaacccgacggatcttgattcagtttccgaatttgggtcgggttgccaaacccaagggatggtgaattatgattgtaatgacttatttgtcccttctgtgccgcccttcggccacagccatgtaaactacatggtgggggcaccaccgtccgaggaggaggttcaaagcggtgtgaggactcaacaggccgatggggccgcatgttttcagcagaacccaaatgcccgattgttaccgggctcgggcgacccatttgggtttgggttcatcatgggtcagcaagttgagttcgggtttagggactgaaggatctgatagtgttgttctgtaaataattggggattttaatttaaattctatgctcattgttatggaaaattgcaattttggtcattcttttcggctagacacatacaatgaatcggtatgaaactgagcaaggatgacccaatggtgctttcaccacagcaccgcatgctgaaaaattaattgctttgcaagacattattgggctaaatatgaatcacgttgtacttcaaagcattacatagcaactattttccaaatttaagtttagtttagagcattagatattgatatttttatgtggttggtgtcccatgcatccttgtagacaacctgatcaacaagcaatgaaccagctgtaaaattgtctagccttgctgattgtgaaaaaagtgagatccacgtgtgaagtgaacccccgtttaatgtgttaaataaatgggtttggattgattagttgaaaaaagttttcaactatg

SEQ ID NO: 158 - protein, 340 aa, Glycine max
  misc_feature (1)..(340): Ceres Clone ID no. 481915
  misc_feature (14)..(139): Pfam Name: NAM Pfam Description: No apical meristem (NAM) protein
  misc_feature (1)..(340): Bit score of 372.2 for HMM based on sequences of Figure 4
  misc_feature (1)..(340): Functional Homolog Of SEQ ID NO. 2
MGVPERDPLAQLSLPPGFRFYPTDEELLVQYLCRKVAGHHFSLPIIAEVDLYKFDPWVLPGKAAFGEKEWYFFSPRDRKYPNGSRPNRVAGSGYWKATGTDKIITTEGRKVGIKKALVFYVGKAPKGSKTNWIMHEYRLLDSSRKHNLGTAKLDDWVLCRIYKKNSSAQKVEANLLAMECSNGSSPSSSSHVDDMLESLPEIDDRCFTLPRVNSVRTMQQQDEKFGFQNMGSGFFTDWVNPTDLDSVSEFGSGCQTQGMVNYDCNDLFVPSVPPFGHSHVNYMVGAPPSEEEVQSGVRTQQADGAACFQQNPNARLLPGSGDPFGFGFIMGQQVEFGFRD

SEQ ID NO: 159 - protein, 260 aa, Brassica napus
  misc_feature (1)..(260): Public GI ID no. 31322580
  misc_feature (11)..(134): Pfam Name: NAM Pfam Description: No apical meristem (NAM) protein
  misc_feature (1)..(260): Bit score of 432.5 for HMM based on sequences of Figure 4
  misc_feature (1)..(260): Functional Homolog Of SEQ ID NO. 2
MVKAGADLQFPPGFRFHPTDEELVLMYLCRKCASQPIAAPIITELDLYRYDAWDLPDMALYGEKEWYFFSPRDRKYPNGSRPNRAAGTGYWKATGADKPIGRPKPVGIKKALVFYSGKPPRGEKTNWIMHEYRLADVDRSVRKGNSLRLDDWVLCRIYNKKGVIEKRRSEVANGHVMAPVMLNFDKPELIGGGSSCSDQRVVSPEFRCEAKTEPSRWSNALEVPFNYVDAIADNEIVSRLLGGNQMWSTLDPLVVRQRTF

SEQ ID NO: 160 - protein, 297 aa, Phytolacca acinosa
  misc_feature (1)..(297): Public GI ID no. 311701727
  misc_feature (14)..(137): Pfam Name: NAM Pfam Description: No apical meristem (NAM) protein
  misc_feature (1)..(297): Bit score of 539.3 for HMM based on sequences of Figure 4
  misc_feature (1)..(297): Functional Homolog Of SEQ ID NO. 2
MMTAAKTVGTELQLPAGFRFHPTDEELVVHYLCRKCASQPISVPIIAEIDLYKFDPWDLPEMATYGEKEWYFFSPRDRKYPNGSRPNRAAGTGYWKATGADKPIGKPKTLAIKKALVFYAGKAPKGVKTNWIMHEYRPANVDRSAGKRTNLRLDDWVLCRIYNKKGIIEKGYYVDQKPMVQYPDFEDKKPVISPPGRNTSVGLATPSPMAPTRNDQLHFDTSDSVPHCHTDTSGSSHVVSPDFICDREVQSEPKWNELEMAFDYPFNYMEPFQSDPFGPSTVQDPMANLHDVLMFLR

SEQ ID NO: 161 - DNA, 561 bp, Brassica napus
  misc_feature (1)..(561): Ceres Clone ID no. 1434586
  misc_feature (1)..(561): Encodes the peptide sequence at SEQ ID NO. 162
aaaaaacatcttcacgaaccagaaacaataagaagaagaagaaaaagtgagatatggtgaaagcaggggctgatttgcaatttccaccgggatttagatttcatccgacggacgaggagctcgtcctcatgtatctctgccgtaaatgcgcgtcgcagccgatcgctgctcctatcatcactgaactcgatttgtatagatatgatgcttgggaccttcccgacatggctttgtacggagaaaaggagtggtattttttctcaccgagagaccggaagtacccaaatggttcaagaccaaaccgggcagctggtactggctattggaaagctacaggtgctgataaaccaatcggtcgtcctaaaccggtcggtataaagaaggctctagtgttttattccggaaaacctccgagaggagagaaaaccaattggattatgcatgaataccggctcgcagacgttgaccggtcggttcggaagggaaacagtttaaggctggacgattgggtgttgtgtcgtatatacaacaagaaaggtgtcatagagaagcgacggagtg

SEQ ID NO: 162 - protein, 169 aa, Brassica napus
  misc_feature (1)..(169): Ceres Clone ID no. 1434586
  misc_feature (11)..(134): Pfam Name: NAM Pfam Description: No apical meristem (NAM) protein
  misc_feature (1)..(169): Bit score of 286.2 for HMM based on sequences of Figure 4
  misc_feature (1)..(169): Functional Homolog Of SEQ ID NO. 2
MVKAGADLQFPPGFRFHPTDEELVLMYLCRKCASQPIAAPIITELDLYRYDAWDLPDMALYGEKEWYFFSPRDRKYPNGSRPNRAAGTGYWKATGADKPIGRPKPVGIKKALVFYSGKPPRGEKTNWIMHEYRLADVDRSVRKGNSLRLDDWVLCRIYNKKGVIEKRRS

SEQ ID NO: 163 - protein, 296 aa, Saccharum officinarum
  misc_feature (1)..(296): Public GI ID no. 58013003
  misc_feature (10)..(134): Pfam Name: NAM Pfam Description: No apical meristem (NAM) protein
  misc_feature (1)..(296): Bit score of 513.9 for HMM based on sequences of Figure 4
  misc_feature (1)..(296): Functional Homolog Of SEQ ID NO. 2
MSGGGQDLQLPPGFRFHPTDEELVMHYLCRRCASLPIAVPIIAEIDLYKFDPWQLPRMALYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYNKKGGLEKPAAASSGDHKPMVFAAGAVSSPPEQKPFVATPGGLPPAAFTADLAAYYDRPSDSMPRLHADSSCSEQVLSPEQLACDREVQSQPKISEWERTFASDPVNPAGSMLVDPVVGGHAGDPLLQDILMYWGKPF

SEQ ID NO: 164 - protein, 337 aa, Ricinus communis
  misc_feature (1)..(337): Public GI ID no. 255586554
  misc_feature (14)..(139): Pfam Name: NAM Pfam Description: No apical meristem (NAM) protein
  misc_feature (1)..(337): Bit score of 375.1 for HMM based on sequences of Figure 4
  misc_feature (1)..(337): Functional Homolog Of SEQ ID NO. 2
MGVQEMDPLTQLSLPPGFRFYPTDEELLVQYLCRKVAGHQFSLQIIGEIDLYKFDPWVLPSKAIFGEKEWYFFSPRDRKYPNGSRPNRVAGSGYWKATGTDKVITTEGRKVGIKKALVFYVGKAPKGTKTNWIMHEYRLLESSRKNGSTKLDDWVLCRIYKKNSGAQKPMTSFPSSKEHSNNGSSSSSSSHLDDVLDSLTEIDDHFFALPTAKTMQPDDKININNLGSGNFDWATLAGLNSVSELATAQQAQSQTQGLMNYTQNGDDLYVPSFQQHIGHVDIKMEEEVQSGVRTHRADSSRFLQQTSSVLTQNLSNSFDPYGFRYSAQPGSGFGFRQ

SEQ ID NO: 165 - DNA, 1304 bp, Glycine max
  misc_feature (1)..(1304): Ceres Clone ID no. 1370400
  misc_feature (1)..(1304): Encodes the peptide sequence at SEQ ID NO. 166
  misc_feature (548)..(548): m is a or c
atgctctccccgccccttccaggacaagaagaagcccttcgatcgtccggtctagctgtttctgcttatcgatatctggtttatcgcagcagtttggagctgtcggattcgagtagctagcttagctctacaatcgagcgagaagaaggatcgaggagatgagcggcggcggcggcggaggatcggcggcgacgcaggggcagcaggatctgcagctgccgccggggttcagattccatccgacggacgaggagctggtgatgcactacctgtgccggcggtgcgccggcctgcccatctccgtgcccatcatcgccgaggtcgacctctacaagttcgacccatggcagctcccgagaatggcgctctacggcgagaaggagtggtacttcttctccccgcgcgaccgcaagtacccgaacgggtcgcggccgaaccggtcggccggcacgggctactggaaggccaccggcgccgacaagccggtgggcacgcccaagcccctggccatcaagaaggcgctcgtcttctatgccgggaaggcgccmaggggcgacaagaccaactggatcatgcacgagtaccgcctcgccgacgtcgaccgctccgcccgcaagaagaacagcctcaggttggatgactgggtgctttgccggatctacaacaagaaaggcgcctcggagaggccgagcgccggtgaccggaccgcgagcgcgagccccgggcacgcggccgtcggctcgccgccggagcagaaaccggccctgctgccgccatacgcgccgcagccgttctcggacctggcggcgtactacgaggtgaggccgtcggactcgatgccgcgggcgcacgcggactcgagctgctcggaacacgtgctgacggcgtcgtgcgagcggccggaggtgcagagccagcccaagatctccgagtgggagcgcacgttcgccacagccaccccgggcgtcaacccggccggcttgatgctcgacccggcggccgggctccccgccggcgacccgctcctccaggacatcctcatgtactggggcaagccgttctgagaatccggctccgtggctgtacgtgtggtttggcgctgggatgaaatcgatcggggtagcggccggaatctatcggcaggagatactcatagccgttggatggaagatatcagtagtgcacaaggagtcacggacggcggcgatgagacgcgggagccccggtgtgttcgaggagggacgcagagagtactcttggtgtatacggatttgaactaagctgtgtatatgcgattgatttgg

SEQ ID NO: 166 - protein, 301 aa, Glycine max
  misc_feature (1)..(301): Ceres Clone ID no. 1370400
  misc_feature (20)..(144): Pfam Name: NAM Pfam Description: No apical meristem (NAM) protein
  misc_feature (1)..(301): Bit score of 484.5 for HMM based on sequences of Figure 4
  misc_feature (1)..(301): Functional Homolog Of SEQ ID NO. 2
  misc_feature (130)..(130): Xaa is any aa, unknown or other
MSGGGGGGSAATQGQQDLQLPPGFRFHPTDEELVMHYLCRRCAGLPISVPIIAEVDLYKFDPWQLPRMALYGEKEWYFFSPRDRKYPNGSRPNRSAGTGYWKATGADKPVGTPKPLAIKKALVFYAGKAXRGDKTNWIMHEYRLADVDRSARKKNSLRLDDWVLCRIYNKKGASERPSAGDRTASASPGHAAVGSPPEQKPALLPPYAPQPFSDLAAYYEVRPSDSMPRAHADSSCSEHVLTASCERPEVQSQPKISEWERTFATATPGVNPAGLMLDPAAGLPAGDPLLQDILMYWGKPF

SEQ ID NO: 167 - protein, 272 aa, Eutrema halophilum
  misc_feature (1)..(272): Public GI ID no. 312283489
  misc_feature (9)..(134): Pfam Name: NAM Pfam Description: No apical meristem (NAM) protein
  misc_feature (1)..(272): Bit score of 326.3 for HMM based on sequences of Figure 4
  misc_feature (1)..(272): Functional Homolog Of SEQ ID NO. 2
MEANSSSNLPPGFRFHPTDEELIVHYLRNQTMSKPCPVSIIPEVDIYKFDPWQLPEKTEFGENEWYFFSPRDRKYPNGVRPNRAAVSGYWKATGTDKAIHSGSSNVGVKKALVFYKGRPPKGIKTDWIMHEYRLHDPRKPSTKRNGSMRLDEWVLCRIYKKKGAGKLLDEKEGFMDEVQIEETLTVVTNEAERRNEEEIMMTSTKIPRTCSLAHLLEMDYMGPISHILTPFDLHHPDYSDSMNMNQSGWFGGDQQINQEEVLNHHCQAMFQF

SEQ ID NO: 168 - DNA, 1050 bp, Solanum lycopersicum
  misc_feature (1)..(1050): Ceres Annot ID no. 8453910
  misc_feature (1)..(1050): Encodes the peptide sequence at SEQ ID NO. 169
atgggtgttcaagaaaaagatccacttttgcaattaagtttaccaccaggatttagattttatccaactgatgaagagcttttagttcaatatttatgtaagaaagttgctggacatgattttcctctacaaattattggtgaaattgatttatacaaatttgatccttgggttttacctagtaaggcgacatttggtgaaaaagaatggtatttcttcagtccgagggataggaagtatccgaatggatctagaccgaatcgagtagcaggttcgggttattggaaagcaacggggacggataaggtgataacttcgcaaggaagaaaagttggaattaagaaagctcttgtgttttatgtgggtaaagctccaaaaggatccaagacgaattggattatgcatgaatatagactttttgaatcttcaaggaaaaataatggaagttcaaagctagatgaatgggtgctttgtcgaatttataagaagaattcaagtggaccaaaacctctgatgtctggtttacacagcagtaatgaatacagccatggttcgtcgacttcgtcatcatcccaattcgatgatatgctcgaatcattaccagaaatggacgatcgattctccaatttaccgaggttgaactctctcaaggccgagaaattcaacctcgatcgtctggattcagccaatttcgattgggcaattctcgctgggctcaaaccaatgccggaattgggcccagcaaatcaagctccaggcgttcagggtcaggctcaggggcatgtcaataaccacattcacagcgacaacaacaatatgaattttctcaacgatgtttacgcccatcctccaaatttccgaggcaacacaaaggttgaaagtattaatctagacgaagaagttgaaagcgggaaaagaaatcaacggattgaccaatcgagttacttccaacagagtctcaatggattttcccaagcgtatacaaacaatgtggatcaattcgggatccaatgtccgaatcagacgttaaatctcgggttcaagcagtag

SEQ ID NO: 169 - protein, 349 aa, Solanum lycopersicum
  misc_feature (1)..(349): Ceres Annot ID no. 8453910
  misc_feature (14)..(139): Pfam Name: NAM Pfam Description: No apical meristem (NAM) protein
  misc_feature (1)..(349): Bit score of 360.4 for HMM based on sequences of Figure 4
  misc_feature (1)..(349): Functional Homolog Of SEQ ID NO. 2
MGVQEKDPLLQLSLPPGFRFYPTDEELLVQYLCKKVAGHDFPLQIIGEIDLYKFDPWVLPSKATFGEKEWYFFSPRDRKYPNGSRPNRVAGSGYWKATGTDKVITSQGRKVGIKKALVFYVGKAPKGSKTNWIMHEYRLFESSRKNNGSSKLDEWVLCRIYKKNSSGPKPLMSGLHSSNEYSHGSSTSSSSQFDDMLESLPEMDDRFSNLPRLNSLKAEKFNLDRLDSANFDWAILAGLKPMPELGPANQAPGVQGQAQGHVNNHIHSDNNNMNFLNDVYAHPPNFRGNTKVESINLDEEVESGKRNQRIDQSSYFQQSLNGFSQAYTNNVDQFGIQCPNQTLNLGFKQ

SEQ ID NO: 170 - DNA, 1409 bp, Panicum virgatum
  misc_feature (1)..(1409): Ceres Clone ID no. 1824711
  misc_feature (1)..(1409): Encodes the peptide sequence at SEQ ID NO. 171
attttttttttcaagactcatgcttgccttctatctaagcactactcctcctagttaattagctagtagcatctctcatctcctcctcccttcttgaggctccgatctatacagtagctagtagtcaacagtagtataaactgtgtgtagtagtagactgttgtgtagaggttgctacagagcaatccaacagctagcacatcagagctgagcagtcaccattgtttatcagtcgccatgacgagctcgactagactgcctaatcttccagctgggttccgcttccaccccacagatgaggagctcatcgtccactacctcatgaaccaagcttcctccatcccatgccctgtccccatcatcgccgaggtcaacatctaccagtgcaacccatgggatcttcctgccaaagctttgtttggagagaacgagtggtacttcttcagcccgagggatcgcaagtaccccaacggcgcccgccccaaccgcgccgccggatccggctactggaaggccaccggcaccgacaaggccatcctgttgactccgacgagcgagaacatcggagtcaagaaggcccttgtgttctacggcggtaagcctcccaagggtgtcaagacagactggatcatgcacgagtaccgcctcacaggagctaacaagaacaccaagcgtagaggatcctccatgaggctggacgactgggtcctctgcaggatccacaagaagagcaacaattttcagttgtctgatcaggaccaggaaggctccactgtggaggaagaatccctcaacaacaagatgaatggcacaattacagcctcgcccaagtctgaagccaataatgatggtcatgatcatcagttccatccgacgacgatggccatgaacaaatcatactcaatcaccgatctcctcaacaccatcgactactcggcgctctcgcagctcctcgatgccccagctgaacctgaaccaccgctaatctacccaacaacaacacaaacacatcacgaagcactacttaactataacaacaacgtgaacaatagccacttcaatatgccacaagtagacgcatattcagatcatgttgcgactaattgcaacggtctgaagaggaagcgagtgatgactatggatggtgctgaatcctccttcgacgatgatggcagcagtaacttcagtagaaaactactgaagctgccaagtgattcacggagcagcagccacagccattttggcagcacgacgagcagctactgcaaccagcagcttgtggacacgagtggttttcagcacagcagcctgctgagctatccattcctcgagatgcagtagtatctatgtagtattacaccgagagcttggtgtgaatgaattcatacagctgaaacttcgactgggtc

SEQ ID NO: 171 - protein, 367 aa, Panicum virgatum
  misc_feature (1)..(367): Ceres Clone ID no. 1824711
  misc_feature (10)..(137): Pfam Name: NAM Pfam Description: No apical meristem (NAM) protein
  misc_feature (1)..(367): Bit score of 342.3 for HMM based on sequences of Figure 4
  misc_feature (1)..(367): Functional Homolog Of SEQ ID NO. 2
MTSSTRLPNLPAGFRFHPTDEELIVHYLMNQASSIPCPVPIIAEVNIYQCNPWDLPAKALFGENEWYFFSPRDRKYPNGARPNRAAGSGYWKATGTDKAILLTPTSENIGVKKALVFYGGKPPKGVKTDWIMHEYRLTGANKNTKRRGSSMRLDDWVLCRIHKKSNNFQLSDQDQEGSTVEEESLNNKMNGTITASPKSEANNDGHDHQFHPTTMAMNKSYSITDLLNTIDYSALSQLLDAPAEPEPPLIYPTTTQTHHEALLNYNNNVNNSHFNMPQVDAYSDHVATNCNGLKRKRVMTMDGAESSFDDDGSSNFSRKLLKLPSDSRSSSHSHFGSTTSSYCNQQLVDTSGFQHSSLLSYPFLEMQ

SEQ ID NO: 172 - protein, 307 aa, Capsicum annuum
  misc_feature (1)..(307): Public GI ID no. 57233056
  misc_feature (13)..(137): Pfam Name: NAM Pfam Description: No apical meristem (NAM) protein
  misc_feature (1)..(307): Bit score of 486.6 for HMM based on sequences of Figure 4
  misc_feature (1)..(307): Functional Homolog Of SEQ ID NO. 2
MIKGIVGNQQLGLPAGFRFHPTDEELVQHYLCRKCAGQSISVSIIAEIDLYKFDPWQLPEKALYGEKEWYFFSQEDRKYPNGSRPNRAAGTGYWKATGADKPVGKPKTLGIKKALVFYAGKAPRGIKTNWIMHEYRLANVDRSAGKSNNLRLDDWVLCRIYNKKGHTLRSITMWASKRGESFGEFEDEIKPKIFPTQLAPAPGQWPPRPQSTPASDYFNFETSESMTTTRMHTTNSSSGSEHVLSSCDKEVQSAPKWDDLGTAALDFQINYLDGLLNDPFEIQMQQQNCNIDQFNTFQDMFLYMQKP

SEQ ID NO: 173 - protein, 260 aa, Mikania micrantha
  misc_feature (1)..(260): Public GI ID no. 167614348
  misc_feature (8)..(132): Pfam Name: NAM Pfam Description: No apical meristem (NAM) protein
  misc_feature (1)..(260): Bit score of 472.8 for HMM based on sequences of Figure 4
  misc_feature (1)..(260): Functional Homolog Of SEQ ID NO. 2
MNCGDLELPPGFRFHPTDDELVMHYLCRKCASQPISVPIIAEIDLYKFDPWQLPGMALYGEKEWYFFSPRDRKYPNGSRPNRAAGTGYWKATGADKPIGKPKPVGIKKALVFYAGKAPRGVKTNWIMHEYRLANVDRSAGKRNNNLRLDDWVLCRIYNKKGTLEEHHVGGDPEVETKPKIIPPSSLTARNDVFHFDPSESVPTLHTDSSPEQSVQSDSNPFSYMDPFQNDHFTPQSQYYNDFQLSPLQDMFMYTSKPFQM

SEQ ID NO: 174 - protein, 265 aa, Vitis vinifera
  misc_feature (1)..(265): Public GI ID no. 296082607
  misc_feature (9)..(133): Pfam Name: NAM Pfam Description: No apical meristem (NAM) protein
  misc_feature (1)..(265): Bit score of 490.3 for HMM based on sequences of Figure 4
  misc_feature (1)..(265): Functional Homolog Of SEQ ID NO. 2
MMSGDQLQLPAGFRFHPTDEELVVHYLVRKCASQSISVPIIAEVDLYKYDPWQLPGMALYGEKEWYFFSPRDRKYPNGSRPNRAAGSGYWKATGADKPIGRPKTVGIKKALVFYAGKAPRGVKTNWIMHEYRLANVDRSAGKKNNLRLDDWVLCRIYNKKGSAEKQHTFDQKSMKYPELEDQKPKIISTTSDSVPRLHTHTDSSGSEQVMSPEKEVQSEPKWNDFDFSLYMDGFANDPFASQAQFSGDLLTSSWQDMLMFSNKSF

SEQ ID NO: 175 - protein, 337 aa, Glycine max
  misc_feature (1)..(337): Public GI ID no. 62546187
  misc_feature (14)..(139): Pfam Name: NAM Pfam Description: No apical meristem (NAM) protein
  misc_feature (1)..(337): Bit score of 370.5 for HMM based on sequences of Figure 4
  misc_feature (1)..(337): Functional Homolog Of SEQ ID NO. 2
MGVPERDPLAQLSLPPGFRFYPTDEELLVQYLCRKVAGHHFSLPIIAEVDLYKFDPWVLPGKAVFGEKEWYFFSPRDRKYPNGSRPNRVAGSGYWKATGTDKIITTEGRKVGIKKALVFYIGKAPKGSKTNWIMHEYRLLDSSRKHNLGTAKLDDWVLCRIYKKNSSSQKVEANFLAMECSNGSSPSSSSHVDDMLGSLPEINDRCFTLPRVNSLRTMHQQDEKFGSPNMGSGFFSDWVNSTDLDSISEFESGCQTQRMVNYDCNDFFVPSLPPLGHVDYMVDAPLEEEVQSGVRTRRVDGPGHFQPNPDTRLLPGSGDPFGFGFIMGQQVEFGFRD

SEQ ID NO: 176 - protein, 345 aa, Glycine max
  misc_feature (1)..(345): Public GI ID no. 62546189
  misc_feature (14)..(139): Pfam Name: NAM Pfam Description: No apical meristem (NAM) protein
  misc_feature (1)..(345): Bit score of 383.3 for HMM based on sequences of Figure 4
  misc_feature (1)..(345): Functional Homolog Of SEQ ID NO. 2
MGVPEEDPLSQLSLPPGFRFYPTDEELLVQYLCRKVAGHHFSLPIIAEIDLYKFDPWVLPSKAIFGEKEWYFFSPRDRKYPNGSRPNRVAGSGYWKATGTDKIITTEGRKVGIKKALVFYIGKAPKGTKTNWIMHEYRLLDSSRKNTGTKLDDWVLCRIYKKNSSAQKAVQNGVVPSNEHTQYSNGSSSSSSSQLDDVLESLPAIDERCFPMPRVNTLQQQQHEEKVNVQNLGEGGLLDWTNPSVLNSVVDFVSGNNNHNQLVQDQTQGMVNYNACNDLYVPALCHVGTSVPQKMEEEVQSGVRNQRVQNNSWFLQNDFTQGFQNSVDTSGFKYPVQPVGFGFRN

SEQ ID NO: 177 - protein, 278 aa, Brassica napus
  misc_feature (1)..(278): Public GI ID no. 31322568
  misc_feature (7)..(131): Pfam Name: NAM Pfam Description: No apical meristem (NAM) protein
  misc_feature (1)..(278): Bit score of 461.8 for HMM based on sequences of Figure 4
  misc_feature (1)..(278): Functional Homolog Of SEQ ID NO. 2
MKAELNLPAGFRFHPTDEELVKFYLCRKCASEEISAPVIAEIDLYKFNPWELPEMSLYGEKEWYFFSHRDRKYPNGSRPNRAAGTGYWKATGADKPIGKPKTLGIKKALVFYAGKAPKGIKTNWIMHEYRLANVDRSASLNKKNNLRLDDWVLCRIYNKKGTMEKYYPADEKPRTTTSMADQSSSPFDTSDSTYQNDSSSSGGHVVSPDAKEVQSEPKWGELEDALEAFDTSMFGGSMDLLQSDGFVPQYLYQPDYFTPFQDPHEQKPFLNWSFAPQG

SEQ ID NO: 178 - protein, 359 aa, Triticum aestivum
  misc_feature (1)..(359): Public GI ID no. 66275774
  misc_feature (13)..(140): Pfam Name: NAM Pfam Description: No apical meristem (NAM) protein
  misc_feature (1)..(359): Bit score of 366.1 for HMM based on sequences of Figure 4
  misc_feature (1)..(359): Functional Homolog Of SEQ ID NO. 2
MPMGSSSAAMPALPPGFRFHPTDEELIVHYLGRQAASMPSPVPIIAEVNIYKCNPWDLPGKALFGENEWYFFSPRDRKYPNGARPNRAAGSGYWKATGTDKAILSTPANESIGVKKALVFYRGKPPKGVKTDWIMHEYRLTAADNRTTKRRGSSMRLDDWVLCRIHKKCNNLHNFSSSDQEQEHEQESSTTVEDSHNNHTVSSPKSEAFDGDGDDQLQLQQFRPMAIAKSCSLTDLLNTVDYAALSHLLLDGAGAGASSSDAGADYQLPPENPLIYSQPPWQQTLHYNNNNNGYVNIDTIDVPQIPEARVDDYGMNGDRYNGMKRKRSSGSLYCSQLQLPADQYSGMLIHPFLSQQLHM

SEQ ID NO: 179 - protein, 294 aa, Vitis vinifera
  misc_feature (1)..(294): Public GI ID no. 225438363
  misc_feature (9)..(133): Pfam Name: NAM Pfam Description: No apical meristem (NAM) protein
  misc_feature (1)..(294): Bit score of 528.5 for HMM based on sequences of Figure 4
  misc_feature (1)..(294): Functional Homolog Of SEQ ID NO. 2
MMSGDQLQLPAGFRFHPTDEELVVHYLVRKCASQSISVPIIAEVDLYKYDPWQLPGMALYGEKEWYFFSPRDRKYPNGSRPNRAAGSGYWKATGADKPIGRPKTVGIKKALVFYAGKAPRGVKTNWIMHEYRLANVDRSAGKKNNLRLDDWVLCRIYNKKGSAEKQHTFDQKSMKYPELEDQKPKIISTVQNKVVPSSLPSLPPMPAPPTTNDYLYFETSDSVPRLHTHTDSSGSEQVMSPEKEVQSEPKWNDFDFSLYMDGFANDPFASQAQFSGDLLTSSWQDMLMFSNKSF

SEQ ID NO: 180 - protein, 298 aa, Cucumis melo
  misc_feature (1)..(298): Public GI ID no. 124021383
  misc_feature (8)..(132): Pfam Name: NAM Pfam Description: No apical meristem (NAM) protein
  misc_feature (1)..(298): Bit score of 497.5 for HMM based on sequences of Figure 4
  misc_feature (1)..(298): Functional Homolog Of SEQ ID NO. 2
MTVAGLELPPGFRFHPTDEELVLHYLCRKCSSQPIAVPIIKEIDLYKYDPWHLPELAVCGEKEWYFFSPRDRKYPNGSRPNRAAGTGYWKATGADKPIGRPKTLGIKKALVFYAGKAPRGVKTNWIMHEYRLANVDRSAANKTNNLRLDDWVLCRIYNKKGCIEKHYQSTDDKAAEFPDFEDEKPNITTNNMVQLPLHNQLQMETSDSVPRMQTESSSGSDLVTSPELTWDKEVQSQSKWEGEGGGERAAVADFDFFEFNYMDSFSMPEDVPFGSQVQFQMDHLSPLQDMFSYLQRQI

SEQ ID NO: 181 - protein, 307 aa, Populus trichocarpa
  misc_feature (1)..(307): Public GI ID no. 224081060
  misc_feature (14)..(138): Pfam Name: NAM Pfam Description: No apical meristem (NAM) protein
  misc_feature (1)..(307): Bit score of 548.5 for HMM based on sequences of Figure 4
  misc_feature (1)..(307): Functional Homolog Of SEQ ID NO. 2
MKVNGSAAADQLELPAGFRFHPTDDELVNHYLIKKCGGQSISVPIIAEIDLYKYDPWQLPEMALYGEKEWYFFSPRDRKYPNGSRPNRAAGTGYWKATGADKPIGRPKPLGIKKALVFYAGKAPRGIKTNWIMHEYRLANVDRSAGKKNNLRLDDWVLCRIYNKKGSIEKHFPADRKSITKYAEMEEQKPNINEMSGYKNGGSTMGAPTMMMSNSNDLLNMDTSDSTPRLHTDSSCSEQVLSPELTCEREVQSQPKSWNDQLDSAFDFNFNYIDDGFQDDPFASQVQFQMDQLSPLQDMFMYLQRPL

SEQ ID NO: 182 - protein, 346 aa, Ricinus communis
  misc_feature (1)..(346): Public GI ID no. 255583865
  misc_feature (15)..(142): Pfam Name: NAM Pfam Description: No apical meristem (NAM) protein
  misc_feature (1)..(346): Bit score of 376.1 for HMM based on sequences of Figure 4
  misc_feature (1)..(346): Functional Homolog Of SEQ ID NO. 2
MESTDSSSGSQQPNLPPGFRFHPTDEELVVHYLKKKASSAPLPVAIIAEVDLYKFDPWELPAKATFGEQEWYFFSPRDRKYPNGVRPNRAATSGYWKATGTDKPVLTSGGTQKVGVKKALVFYGGKPPKGIKTNWIMHEYRLADNKVSNKPPGCDLANKKNSLRLDDWVLCRIYKKNNTNRPMDQEKDDSMEDMLGSIPPSLTIGSQQNARLQLLKGTNYGTLVENDTSFFNDHSISNTNSISQLASSTCSRPGDLSMLPLKRTLPSLYWSDDVDMAASPSSSKRYQGDHTGDESVVRSDGNGSFVSLLSQLPQTPPLHQQQATLGSIGDGIFRPPYQLSGLNWYS

SEQ ID NO: 183 - protein, 292 aa, Medicago truncatula
  misc_feature (1)..(292): Public GI ID no. 217073174
  misc_feature (7)..(131): Pfam Name: NAM Pfam Description: No apical meristem (NAM) protein
  misc_feature (1)..(292): Bit score of 508.0 for HMM based on sequences of Figure 4
  misc_feature (1)..(292): Functional Homolog Of SEQ ID NO. 2
MQGELELPPGFRFHPTDEELVNHYLCRKCAGQSISVPVVKEVDLYKFDPWQLPEMGYHSEKEWYFFSPRDRKYPNGSRPNRAAGSGYWKATGADKPIGKLKPMGIKKALVFYAGKAPKGVKTNWIMHEYRLANVDRSAGKKNNLRLDDWVLCRIYNKKGKIEKFNTSNTPKVQNYYEHEEVEEHEMKPEIQKLGNYQLYMDTSDSVPKLHTDSSSSGGHVVSPDVTCDREVQSEPKWNDLGIQLDDAFDFQLNYLENALSFDIDDDPFGTNQYQMNQLSPLQDMFMYPQKPF

SEQ ID NO: 184 - protein, 203 aa, Physcomitrella patens
  misc_feature (1)..(203): Public GI ID no. 168038326
  misc_feature (1)..(203): Physcomitrella patens subsp. patens
  misc_feature (17)..(145): Pfam Name: NAM Pfam Description: No apical meristem (NAM) protein
  misc_feature (1)..(203): Bit score of 279.0 for HMM based on sequences of Figure 4
  misc_feature (1)..(203): Functional Homolog Of SEQ ID NO. 2
MVILASPTGGPVTQLQLPPGFRFHPTDEELVLHYLCRKAESHVFAIPVIAEIDLYKFDPWDLPGKAIFGEREWYFFSPRDRKYPNGARPNRAAASGYWKATGTDKPIHTSVGGIRKIGVKKALVFYKGRAPKGVKTNWIMHEYRLAEGVCASVHAHRKGSLRLDDWVLCRIYKKSTNAQRTGKERDSSSCVEEVSKLSFGSHS

SEQ ID NO: 185 - protein, 264 aa, Lycoris longituba
  misc_feature (1)..(264): Public GI ID no. 295913643
  misc_feature (8)..(132): Pfam Name: NAM Pfam Description: No apical meristem (NAM) protein
  misc_feature (1)..(264): Bit score of 477.5 for HMM based on sequences of Figure 4
  misc_feature (1)..(264): Functional Homolog Of SEQ ID NO. 2
MSSGDLQLPPGFRFHPTDVELVMHYLCRKCAGLPLAVPIIAEIDLYKFDPWQLPEMALYGEKEWYFFTPRDRKYPNGSRPNRAAGSGYWKATGADKPVGSPKPIAIKKALVFYSGKAPKGDKSNWIMHEYRLADVDRSVRRKNSLRLDDWVLCRIYKKKGGAEKVGGADKTPAGSRMIRPLLEPKPEFIPQVPQFNSNGNTDYFCLDMADSMPKLHAESSCSEHVLSPEFTCEREVESQLKWNELERALGVANNYADATTALAL

SEQ ID NO: 186 - protein, 285 aa, Brassica napus
  misc_feature (1)..(285): Public GI ID no. 31322578
  misc_feature (6)..(130): Pfam Name: NAM Pfam Description: No apical meristem (NAM) protein
  misc_feature (1)..(285): Bit score of 526.3 for HMM based on sequences of Figure 4
  misc_feature (1)..(285): Functional Homolog Of SEQ ID NO. 2
MSELQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSSAARKKKNSLRLDDWVLCRIYNKKGAIEKRGPPPTPVVYGDEVVEEKPRLSEMGMPPPPVMPNDFVYFDTSDSVPKLHTTESSCSEQVVSPEFTSEVQSEPKWKDWSGEKSSLDFGFNYIDATAFGGGGGSNQLFPLQDMFMYNMPKPY

SEQ ID NO: 187 - protein, 233 aa, Populus trichocarpa
  misc_feature (1)..(233): Public GI ID no. 118486672
  misc_feature (14)..(139): Pfam Name: NAM Pfam Description: No apical meristem (NAM) protein
  misc_feature (1)..(233): Bit score of 311.3 for HMM based on sequences of Figure 4
  misc_feature (1)..(233): Functional Homolog Of SEQ ID NO. 2
MGLQETDPLAQLSLPPGFRFHPTDEELLVQYLCKKVAGHHFSLQIIGEIDLYKFDPWFLPGKAIFGEKEWYFFSPRDRKYPNGSRPNRVAGSGYWKATGTDKVITTEGRKVGIKKALVFYVGKAPKGTKTNWIMHEYRLLESSRKSGSTKLDEWVLCRIYKKNSSAAQKSMSSVSSKEYSTNGSCSSSSSHLEDVLDSLTEIDDRLFALPRTNSLKQMQRRENQLSKSGFREL

SEQ ID NO: 188 - protein, 317 aa, Arabidopsis thaliana
  misc_feature (1)..(317): Public GI ID no. 15232604
  misc_feature (14)..(139): Pfam Name: NAM Pfam Description: No apical meristem (NAM) protein
  misc_feature (1)..(317): Bit score of 368.4 for HMM based on sequences of Figure 4
  misc_feature (1)..(317): Functional Homolog Of SEQ ID NO. 2
MGLQELDPLAQLSLPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTKLDDWVLCRIYKKQTSAQKQAYNNLMTSGREYSNNGSSTSSSSHQYDDVLESLHEIDNRSLGFAAGSSNALPHSHRPVLTNHKTGFQGLAREPSFDWANLIGQNSVPELGLSHNVPSIRYGDGGTQQQTEGIPRFNNNSDVSANQGFSVDPVNGFGYSGQQSSGFGFI

SEQ ID NO: 189 - DNA, 984 bp, Sorghum bicolor
  misc_feature (1)..(984): Ceres Annot ID no. 8683724
  misc_feature (1)..(984): Encodes the peptide sequence at SEQ ID NO. 190
atggactgcggtggcgcgctgcagctcccgcccgggttccggttccaccccaccgacgacgagctggtgatgtactacctcctccgcaagtgcggcggcctgcccctcgccgcgccggtcatcgccgaggtcgacctctacaagttcgatccatggcagctcccagagaaggcgtatggtggggagaaggagtggtacttcttctcgccgagggaccgcaagtacccgaacgggtcgaggccgaacagggcggccgggacggggtactggaaggccaccggcgccgacaagcccgtcgggtcgccgcgccccgtcgccatcaagaaggccctcgtcttctacgccggcaagccgcccaagggcgtcaagaccaactggatcatgcacgagtaccgcctcgccgacgtcgaccgttccgccgccgcacgcaagaagaccaacaacgccctcaggctggatgactgggtgctgtgccggatctacaacaagaagggcgtgatcgagcggtacgacacggtggacgacgacgccgacgacgccgtggcagaggacgtcaagcctgcgccggcgtccaggaataacccgcgcgggaccgccagtggccgcggcggggcagcagcagcagcggcgccgatgaaggtggagttcccggagtacggtgggtactacgactacgaagacctcgaggcgacgccgtcggcggggatgctgtgcttcgatcgcccctgcggctccgagcacgtgctgtcgccgtcgccggacctccccgaccgcgaccacgccgagagccagtccgccgggttatggtggcccgtcggcgtcggcggcgactgggccgccgccgaggacgggttcatggtcgacgtcgacgtcgacgacgggagctcgctgttcgggccgccgtccccggggctgccgttcgctcgcgtcgacgccgccgcgttcggcgacatgctcgcgtcgtacctccacaagccgttctga

SEQ ID NO: 190 - protein, 327 aa, Sorghum bicolor
  misc_feature (1)..(327): Ceres Annot ID no. 8683724
  misc_feature (9)..(133): Pfam Name: NAM Pfam Description: No apical meristem (NAM) protein
  misc_feature (1)..(327): Bit score of 406.8 for HMM based on sequences of Figure 4
  misc_feature (1)..(327): Functional Homolog Of SEQ ID NO. 2
MDCGGALQLPPGFRFHPTDDELVMYYLLRKCGGLPLAAPVIAEVDLYKFDPWQLPEKAYGGEKEWYFFSPRDRKYPNGSRPNRAAGTGYWKATGADKPVGSPRPVAIKKALVFYAGKPPKGVKTNWIMHEYRLADVDRSAAARKKTNNALRLDDWVLCRIYNKKGVIERYDTVDDDADDAVAEDVKPAPASRNNPRGTASGRGGAAAAAAPMKVEFPEYGGYYDYEDLEATPSAGMLCFDRPCGSEHVLSPSPDLPDRDHAESQSAGLWWPVGVGGDWAAAEDGFMVDVDVDDGSSLFGPPSPGLPFARVDAAAFGDMLASYLHKPF

SEQ ID NO: 191 - protein, 343 aa, Glycine max
  misc_feature (1)..(343): Public GI ID no. 187940303
  misc_feature (14)..(139): Pfam Name: NAM Pfam Description: No apical meristem (NAM) protein
  misc_feature (1)..(343): Bit score of 388.8 for HMM based on sequences of Figure 4
  misc_feature (1)..(343): Functional Homolog Of SEQ ID NO. 2
MGVPEKDPLSQLSLPPGFRFYPTDEELLVQYLCRKVAGHHFSLPIIAEIDLYKFDPWVLPSKAIFGEKEWYFFSPRDRKYPNGSRPNRVAGSGYWKATGTDKIITTEGRKVGIKKALVFYVGKAPKGTKTNWIMHEYRLLDSSRKNTGTKLDDWVLCRIYKKNSSAQKTAQNGVVPSNEHTQYSNGSSSSSSSQLEDVLESLPSIDERCFAMPRVNTLQQQQHHEEKVNVQNLGAGGLMDWTNPSVLNSVADFASGNNQVVQDQTQGMVNYNCNDLYVPTLCHLDSSVPLKMEEEVQSGVRNQRVGNNNSWFLQNDFTQGFHNSVDTCGFKYPVQPVGFGFRN

SEQ ID NO: 192 - protein, 311 aa, Nicotiana tabacum
  misc_feature (1)..(311): Public GI ID no. 311780299
  misc_feature (14)..(138): Pfam Name: NAM Pfam Description: No apical meristem (NAM) protein
  misc_feature (1)..(311): Bit score of 533.0 for HMM based on sequences of Figure 4
  misc_feature (1)..(311): Functional Homolog Of SEQ ID NO. 2
MIKGVHRNQQQLELPAGFRFHPTDEELVQHYLCRKCAGQPISVSIIAEIDLCKFDPWQLPEKASHGEKEWYFFSPRDRKYPNGSRPNRAAGAGYWKATGADKPVGKPKTLGIKKALVFYAGKAPRGIKTNWIMHEYRLANVDRSAGKSNNNLRLDDWVLCRIYNKKGTLEKYYNVDNKEHLGFDEVEEEEEKPKVLPFSQSNELIAQLAPAPMPPRPQSMPGYFHFETSESMTRMHTTNSSSGSEHVLSSCNKEVQSAPKWDDLDNALDFQLNYLDSFQYDPFEPQMQQQNCNIDQFNSFQDMFVYMQKPY

SEQ ID NO: 193 - protein, 317 aa, Arabidopsis lyrata
  misc_feature (1)..(317): Public GI ID no. 297830130
  misc_feature (1)..(317): Arabidopsis lyrata subsp. lyrata
  misc_feature (14)..(139): Pfam Name: NAM Pfam Description: No apical meristem (NAM) protein
  misc_feature (1)..(317): Bit score of 364.9 for HMM based on sequences of Figure 4
  misc_feature (1)..(317): Functional Homolog Of SEQ ID NO. 2
MGLQELDPLAQLSLPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTKLDDWVLCRIYKKQSSAQKQAYNNLMTSGREYSNNGSSTSSSSHQYDDVLESLHEIDNRSLGFAAGSSNSLPRCHRPVLTNQKTGFHGLAREPSFDWANLVGQNSVPELGLSQNVPSLRYGDGGTQQQAEGIPRFNYNSDVLAHQGFSVDPVNGFGYSGQQSSGFGFI

SEQ ID NO: 194 - protein, 339 aa, Cymbidium hybrid
  misc_feature (1)..(339): Public GI ID no. 117586720
  misc_feature (1)..(339): Cymbidium hybrid cultivar
  misc_feature (8)..(133): Pfam Name: NAM Pfam Description: No apical meristem (NAM) protein
  misc_feature (1)..(339): Bit score of 348.5 for HMM based on sequences of Figure 4
  misc_feature (1)..(339): Functional Homolog Of SEQ ID NO. 2
MSTSSVHLPPGFRFHPTDEELILHYLRNRAASSPCPASIIAEVDIYKFDPWDLPEKAAFGDREWYFFTPRDRKYPNGNRPNRAAGSGYWKATGTDKPISSGSENIGVKKALVFYKGRPPKGLKTNWIMHEFRLADANKSNSYKPIRLRDHSMRLDDWVLCRIYRKSNHLSPTEMDQEQEDPCGEETCFPAMQNQMMPMNHGMKLQKVSSISEFLQEYSPLLNLFDNQQEIPRFDSNSLLGHPLLSQSMINQNQDSGGNGYFLPQLSQAESPVSIGAKRQRMDDCTNEESNGTSHSSKKQNDLNMFPNFSSQFDGSQYGLLSQPFFSQQLLMNSNTGSLH

SEQ ID NO: 195 - protein, 283 aa, Lotus japonicus
  misc_feature (1)..(283): Public GI ID no. 193237579
  misc_feature (7)..(131): Pfam Name: NAM Pfam Description: No apical meristem (NAM) protein
  misc_feature (1)..(283): Bit score of 498.6 for HMM based on sequences of Figure 4
  misc_feature (1)..(283): Functional Homolog Of SEQ ID NO. 2
MKGELELPPGFRFHPTDEELVNHYLCTKCAGQSFNYSVIKEIDLYKFDPWQLPEMGFDGEKEWYFFSPRDRKYPNGSRPNRAAGSGYWKATGADKPIGKPKALGIKKALVFYVGKAPKGIKTNWIMHEYRLANVDRSAGKKSNLRLDDWVLCRIYNKKGKIEKYNTPTPKFSGLGEVHDSYDEHEHERKPEIHDQLYMEASDSVPRLHTDSSGSEHAASPDVTCDKEVQSEPQWNNELEFKLDDGTFDFQFSFLDDNNMSVDEYQLNQLSPLQDMFMYLEKPF

SEQ ID NO: 196 - DNA, 637 bp, Panicum virgatum
  misc_feature (1)..(637): Ceres Clone ID no. 1827014
  misc_feature (1)..(637): Encodes the peptide sequence at SEQ ID NO. 197
aagaacatcgacgaatccacaggacaccgccagagctcgctctcaaccagcagcagcagccggagctgaggagagcgttgcggtttcagagtgggagggagaaatcaaggagcccgcttcagtctgccgatcaattgcagcttcatcttccccggccgatcagcgatcgccatgggagtgccggtgaggagggagagggacgcggaggcggagctgaacctcccgccggggttccggttccacccgacggacgacgagctggtggagcactacctgtgccggaaggcggcggggcagcgcctcccggtgcccatcatcgcggaggtggacctgtacaagttcgacccctgggacctgccggagcgcgcgctgttcggcacccgggagtggtacttcttcacgcccagggaccgcaagtaccccaaccgctcgcgccccaaccgcgccgccgggaacggctactggaacgccaccggcaccgacaagcccgtcgctccgcgggggcgcacgctggggatcaagaaggcgctcgagttctacgccggcaaggcgccgcgcggggtccagaccgactggatcatgcacgagtacaggcctcgccgacccccgcccccgccgccccggccaagaaggggtc

SEQ ID NO: 197 - protein, 155 aa, Panicum virgatum
  misc_feature (1)..(155): Ceres Clone ID no. 1827014
  misc_feature (17)..(141): Pfam Name: NAM Pfam Description: No apical meristem (NAM) protein
  misc_feature (1)..(155): Bit score of 204.1 for HMM based on sequences of Figure 4
  misc_feature (1)..(155): Functional Homolog Of SEQ ID NO. 2
MGVPVRRERDAEAELNLPPGFRFHPTDDELVEHYLCRKAAGQRLPVPIIAEVDLYKFDPWDLPERALFGTREWYFFTPRDRKYPNRSRPNRAAGNGYWNATGTDKPVAPRGRTLGIKKALEFYAGKAPRGVQTDWIMHEYRPRRPPPPPPRPRRG

SEQ ID NO: 198 - protein, 286 aa, Brassica napus
  misc_feature (1)..(286): Public GI ID no. 31322576
  misc_feature (6)..(130): Pfam Name: NAM Pfam Description: No apical meristem (NAM) protein
  misc_feature (1)..(286): Bit score of 526.8 for HMM based on sequences of Figure 4
  misc_feature (1)..(286): Functional Homolog Of SEQ ID NO. 2
MSELQLPPGFRFHPTDEELVMHYLCRKCASQSIAVPIIAEIDLYKYNPWELPGLALYGEKEWYFFSPRDRKYPNGSRPNRSAGSGYWKATGADKPIGLPKPVGIKKALVFYAGKAPKGEKTNWIMHEYRLADVDRSAARKKKNSLRLDDWVLCRIYNKKGAIEKRGPPPTPVVYGDEVVEEKPRLSEMGMPPPPVMPNDFVYFDTSDSVPKLHTTESSCSEQVVSPEFTSEVQSEPKWKDWSGAANDKNSLDFGFNYIDATAFGGVGSNQLFPLQDMFMYNMPKPY

SEQ ID NO: 199 - protein, 355 aa, Ricinus communis
  misc_feature (1)..(355): Public GI ID no. 255555947
  misc_feature (15)..(142): Pfam Name: NAM Pfam Description: No apical meristem (NAM) protein
  misc_feature (1)..(355): Bit score of 374.3 for HMM based on sequences of Figure 4
  misc_feature (1)..(355): Functional Homolog Of SEQ ID NO. 2
MESTDSSSGSQHPHLPPGFRFHPTDEELVVHYLKKKAASAPLPVTIIAEVDLYKFDPWELPSKATFGEQEWYFFSPRDRKYPNGARPNRAATSGYWKATGTDKPILASNGAQKVGVKKALVFYGGKPPKGIKTNWIMHEYRLVDNNNSSSKPPGFDLANKKGSLRLDDWVLCRIYKKNNSQRTMDRDKEDSMEGFLATLPINPKPASSSVSKPAHAYGSVLDNEENFFEGILTGGDGMQNSSVSHQFPSSSPKQHMSIASISTSNPLAIKRVIPSQYWNHEAIAGSSIAAASSGKRFHGDLNSCSTGTEDNTSFVSLLSQLPQAGAPFHSNTFIGSLGDGVLRQQFQLPSMNWNS

SEQ ID NO: 200 - protein, 330 aa, Oryza sativa
  misc_feature (1)..(330): Public GI ID no. 125533643
  misc_feature (1)..(330): Oryza sativa Indica Group
  misc_feature (9)..(133): Pfam Name: NAM Pfam Description: No apical meristem (NAM) protein
  misc_feature (1)..(330): Bit score of 418.4 for HMM based on sequences of Figure 4
  misc_feature (1)..(330): Functional Homolog Of SEQ ID NO. 2
MECGGALQLPPGFRFHPTDDELVMYYLCRKCSGLPLAAPVIAEVDLYKFNPWDLPERAMGGEKEWYFFSPRDRKYPNGQRPNRAAGTGYWKATGADKPVGSPRAVAIKKALVFYAGKPPKGVKTNWIMHEYRLADVDRSAAARKLSKSSHNALRLDDWVLCRIYNKKGVIERYDTVDAGEDVKPAAAAAAKGGRIGGGGGAAAMKVELSDYGFYDQEPESEMLCFDRSGSADRDSMPRLHTDSSGSEHVLSPSPSPDDFPGGGGGDHDYAESQPSGGCGGWPGVDWAAVGDDGFVIDSSLFELPSPAAFSRGGGDGAAFGDMFTYLQKPF

SEQ ID NO: 201 - protein, 282 aa, Solanum tuberosum
  misc_feature (1)..(282): Public GI ID no. 118490007
  misc_feature (9)..(134): Pfam Name: NAM Pfam Description: No apical meristem (NAM) protein
  misc_feature (1)..(282): Bit score of 332.3 for HMM based on sequences of Figure 4
  misc_feature (1)..(282): Functional Homolog Of SEQ ID NO. 2
MVGKTSSDLPPGFRFHPTDEELIMYYLRYQATSRPCPVSIIPEIDIYKFDPWELPEKAEFGENEWYFFTPRDRKYPNGVRPNRAAVSGYWKATGTDKAIYSANKYVGIKKALVFYKGKPPKGVKTDWIMHEYRLSDSKSQTYSKQSGSMRLDDWVLCRIYKKKNLGKTIEMMKVEVEELEAQNVSINNAIEVVGGPQTMKLPRICSLSHLLELDYYGSIPQLLSDNLLYDDQSYTMNNMSNTSNVDQVSSQQQNTNNITSNNCNIFFNYQQPLFVNPTFQSQ

SEQ ID NO: 202 - protein, 317 aa, Arabidopsis thaliana
  misc_feature (1)..(317): Public GI ID no. 21536744
  misc_feature (14)..(139): Pfam Name: NAM Pfam Description: No apical meristem (NAM) protein
  misc_feature (1)..(317): Bit score of 365.6 for HMM based on sequences of Figure 4
  misc_feature (1)..(317): Functional Homolog Of SEQ ID NO. 2
MGLQELDPLAQLSLPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTNLDDWVLCRIYKKQTSAQKQAYNNLMTSGREYSNNGSSTSSSSHQYDDVLESLHEIDNRSLGFAAGSSNALPHSHRPVLTNHKTGFQGLAREPSFDWANLIGQNSVPELGLSHNVPSIRYGDGGTQQQTEGIPRFNNNSDVSANQGFSVDPVNGFGYSGQQSSGFGFI

SEQ ID NO: 203 - protein, 364 aa, Malus x domestica
  misc_feature (1)..(364): Public GI ID no. 302399025
  misc_feature (25)..(152): Pfam Name: NAM Pfam Description: No apical meristem (NAM) protein
  misc_feature (1)..(364): Bit score of 372.4 for HMM based on sequences of Figure 4
  misc_feature (1)..(364): Functional Homolog Of SEQ ID NO. 2
MECTDSSAGSQQQQHQQPPPPQPNLPPGFRFHPTDEELVVHYLKKKATSAPLPVAIIAEVDLYKFDPWELPAKATFGEQEWYFFSPRDRKYPNGARPNRAATSGYWKATGTDKPVLTSGDTQKVGVKKALVFYGGKPPKGIKTNWIMHEYRLADNKPNNKPPGCDLGNKKNSMRLDDWVLCRIYKKNNTHRPMDHEREDSMEDIMGPLMPPSISHVGHHQNMKLHFPKSNSSYGPPFMENDQIFFDGIMSSTDGSASTHQLQLKRPIVPSWYWNNQEDDQTAADPSSSKRIQLHQLDNGTNSNGAGINGGSTNNNSSSIANLLSQLPQTPPLHQHAVLGSLGDGIFRTPYQLPGMNWYSESNLG

SEQ ID NO: 204 - DNA, 852 bp, Gossypium hirsutum
  misc_feature (1)..(852): Ceres Clone ID no. 100046091
  misc_feature (1)..(852): Encodes the peptide sequence at SEQ ID NO. 205
gcctctcaaaacaaaccataaaagtcctatgatgctcttcttctctggtaaactttcagaattcaaagtaaaatattctcaatttcattactgagttatatatacatacatatatatatttgaaggtgtcgcaatggagagcaccgactcgtcgaccggatcacagcagccgaacctcccaccgggattccggttccaccccactgatgaggaactagtggtacactacctcaagaaaaaagctagctccgctcctttgccggttgcaattattgctgaggttgatttgtacaagtttgatccatgggaattgccagcgaaggcaacgtttggtgaacaagaatggtacttttttagtccgagagacaggaagtatccgaatggagcgagaccgaacagggcggctacctcgggttactggaaggcaaccgggacggataagccggtgttgacttcgggagggactcaaaaggttggtgtgaagaaggcactggttttttatggagggaagccccctaaagggatcaaaaccaattggatcatgcatgaatataggcttgctgataataagactaacaacaaaccccctggatgtgacttgggcaacaagaaaaactcactaaggcttgatgattgggtgttatgtcgaatctacaagaaaaacaacgcgaatagacctctggaacatgataaagatgactccatggatgacatgcttggtactgtaccaccttcgatatcaatcggtagccaacataatccaaaattccacttctcaacaaagggaacaagttttggcacattactagaacatcaagaacataatagtctgtttgatggaatgatggggag

SEQ ID NO: 205 - protein, 239 aa, Gossypium hirsutum
  misc_feature (1)..(239): Ceres Clone ID no. 100046091
  misc_feature (15)..(142): Pfam Name: NAM Pfam Description: No apical meristem (NAM) protein
  misc_feature (1)..(239): Bit score of 321.0 for HMM based on sequences of Figure 4
  misc_feature (1)..(239): Functional Homolog Of SEQ ID NO. 2
MESTDSSTGSQQPNLPPGFRFHPTDEELVVHYLKKKASSAPLPVAIIAEVDLYKFDPWELPAKATFGEQEWYFFSPRDRKYPNGARPNRAATSGYWKATGTDKPVLTSGGTQKVGVKKALVFYGGKPPKGIKTNWIMHEYRLADNKTNNKPPGCDLGNKKNSLRLDDWVLCRIYKKNNANRPLEHDKDDSMDDMLGTVPPSISIGSQHNPKFHFSTKGTSFGTLLEHQEHNSLFDGMMG

SEQ ID NO: 206 - DNA, 1293 bp, Arabidopsis thaliana
  misc_feature (1)..(1293): Ceres Clone ID no. 20909
  misc_feature (1)..(1293): Encodes the peptide sequence at SEQ ID NO. 207
aagtttcaaaaacgccaagtttcagaggtagagagagagatactacaattgattaggataggatcaggatcatcctcaacaacctcctcctaattcctcctccattcatagtaacaataatattaagaaagagggtaaactatgtcagaattattacagttgcctccaggtttccgatttcaccctaccgatgaagagcttgtcatgcactatctctgccgcaaatgtgcctctcagtccatcgccgttccgatcatcgctgagatcgatctctacaaatacgatccatgggagcttcctggtttagccttgtatggtgagaaggaatggtacttcttctctcccagggacagaaaatatcccaacggttcgcgtcctaaccggtccgctggttctggttactggaaagctaccggagctgataaaccgatcggactacctaaaccggtcggaattaagaaagctcttgttttctacgccggcaaagctccaaagggagagaaaaccaattggatcatgcacgagtaccgtctcgccgacgttgaccggtccgttcgcaagaagaagaatagtctcaggctggatgattgggttctctgccggatttacaacaaaaaaggagctaccgagaggcggggaccaccgcctccggttgtttacggcgacgaaatcatggaggagaagccgaaggtgacggagatggttatgcctccgccgccgcaacagacaagtgagttcgcgtatttcgacacgtccgattcggtgccgaagctgcatacgacggattcgagttgctcggagcaggtggtgtcgccggagttcacgagcgaggttcagagcgagcccaagtggaaagattagtcggccgtaagtaatgacaataacaatacccttgattttgggtttaattacattgatgccaccgtggataacgcgtttggaggaggagggagtagtaatcagatgtttccgctacaggatatgttcatgtacatgcagaagccttactagaagggaattcctttcctgccgccgaaacgcaacgcaaaacgaccctcgtttttgcgtttatggcaacacgagaccgttttatatggtcaatgagtgtgccgattcggccattagatttctgttcagtgttcgtttattctatagaccgtccgatttcagatcatccctaatcggacggtggtcgttggatgtatcagtagtgtattactgtgttaggtagaagaaaatccacttgttcttaaattggcataaaagtcagaagctaatatttatatgtgccac

SEQ ID NO: 207 - protein, 239 aa, Arabidopsis thaliana
  misc_feature (1)..(239): Ceres Clone ID no. 20909
  misc_feature (7)..(131): Pfam Name: NAM Pfam Description: No apical meristem (NAM) protein
  misc_feature (1)..(239): Bit score of 439.4 for HMM based on sequences of Figure 4
  misc_feature (1)..(239): Functional Homolog Of SEQ ID NO. 2
MSELLQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSVRKKKNSLRLDDWVLCRIYNKKGATERRGPPPPVVYGDEIMEEKPKVTEMVMPPPPQQTSEFAYFDTSDSVPKLHTTDSSCSEQVVSPEFTSEVQSEPKWKD

SEQ ID NO: 208 - DNA, 1217 bp, Panicum virgatum
  misc_feature (1)..(1217): Ceres Clone ID no. 1803889
  misc_feature (1)..(1217): Encodes the peptide sequence at SEQ ID NO. 209
aagccctcctcccctcttcctaccattagcagaagagaagaagacagaggctctgcgcagagcagcagcaacagctgagcgcgatcgatcgagagagagagacagacacgatgagcggcggcggtcaggacctgcatctgccgccggggttccggttccacccgacggacgaggagctggtgatgcactacctctgccgccagtgcgctgggctccccatcgccgtccccatcatcgccgagatcgacatctacaagttcgacccatggcagctccccagaatggcgcagtacggcgagaaggagtggtacttcttctccccgcgggaccgcaagtacccgaacgggtcgcggccgaaccgcgccgccgggtctgggtactggaaggccaccggtgccgacaagcccgtgggcacgcccaagcccctcgccatcaagaaggcgctcgtcttctacgccggcaaggcgcccaagggcgagaagaccaactggatcatgcacgagtaccgcctcgccgacgtcgaccgctccgcccgcaagaagaacagcctcaggctggatgactgggtcctgtgccgcatctacaagaagaagggcgggctggagaagccgccggtgggcgccggcgaccgcaagccggcgctcgccgcggcggcgggctccccgccggagcagaagccgttcgtggcgtcggcgggcgggctgccccccgcgttcgcggacctggcggcgtactacgaccggccgtcggactcgatgccgcggctgcacgcggactcgagctgctcggagcaggtgctgtccccggagcagcagttcgcctgcgaccgggaggtgcagagccagcccaagatcagcgagtgggagcgcaccttctcctccgaccccgtgaaccccgccggctccatgctcgaccccggcgccggcgacccgctgctgcaggacatcctcatgtactggggcaagccgttctagaggtcacgtacgcgcgcgaaccaagggaacggcagagcgttgcgcagccccatcctggggtgcggttggttggcctgcctctctctcggcggcgcaaccgccgcggcgtgggcttgactcaggcgagccgccatagctgactagtactaagagctttaaaaaatggatggattggacggagatgtcatcgtcatcatcccatcataaactaaaacaagatgatggactgggattcgaggcggc

SEQ ID NO: 209 - protein, 287 aa, Panicum virgatum
  misc_feature (1)..(287): Ceres Clone ID no. 1803889
  misc_feature (10)..(134): Pfam Name: NAM Pfam Description: No apical meristem (NAM) protein
  misc_feature (1)..(287): Bit score of 498.5 for HMM based on sequences of Figure 4
  misc_feature (1)..(287): Functional Homolog Of SEQ ID NO. 2
MSGGGQDLHLPPGFRFHPTDEELVMHYLCRQCAGLPIAVPIIAEIDIYKFDPWQLPRMAQYGEKEWYFFSPRDRKYPNGSRPNRAAGSGYWKATGADKPVGTPKPLAIKKALVFYAGKAPKGEKTNWIMHEYRLADVDRSARKKNSLRLDDWVLCRIYKKKGGLEKPPVGAGDRKPALAAAAGSPPEQKPFVASAGGLPPAFADLAAYYDRPSDSMPRLHADSSCSEQVLSPEQQFACDREVQSQPKISEWERTFSSDPVNPAGSMLDPGAGDPLLQDILMYWGKPF

SEQ ID NO: 210 - DNA, 915 bp, Populus trichocarpa
  misc_feature (1)..(915): Ceres Annot ID no. 1456291
  misc_feature (1)..(915): Encodes the peptide sequence at SEQ ID NO. 211
atgaaaggaaatagatcagcagatcagttggagttaccagctggatttagatttcatccaacagatgatgagttggtgaatcattacttgcttaagaaatgtggaggccaatcaatttctgctcctattattgctgagattgatctttataagtatgatccttggcagcttccagaaatggcactatatggtgaaaaggaatggtacttcttttctccaagggatagaaaatatccaaacggttcaaggccgaaccgggcggctggaaccgggtattggaaagcaaccggagcagataaacccattggtcggcccaaaccactaggcataaaaaaagctcttgtattttatgctggtaaagctcctaaaggaatcaaaaccaattggatcatgcatgaatatcgccttgctaatgttgacaggactgccggcaagaaaaataacctcaggcttgatgattgggtattatgtagaatatacaacaagaaaggaagcgtagagaagcattttcctgctgaaagaaaatcaatagcaaagtatccagagatggaagagcagaagcccaacatcagtgaaatgtctggctatcataatggaatgtcacaaattgcagcaccgacaatgatgatgagtaatagcaatgacttcttatatatggacacatctgattcaattccaaggttgaatacagactcaagtagttcagagcacgtgctgtcacctgaggtcacatgcgagaaggaggttcagagtcagccaaaatggaatgatcagctagataatgccttcgatttcaacttcaattacattgatgatggcttccaagattacccttttgcttcacaagatcagttccaattggaccagctctcacctttgcaggacatgttcatgtatttacagaagccattttga

SEQ ID NO: 211 - protein, 304 aa, Populus trichocarpa
  misc_feature (1)..(304): Ceres Annot ID no. 1456291
  misc_feature (12)..(136): Pfam Name: NAM Pfam Description: No apical meristem (NAM) protein
  misc_feature (1)..(304): Bit score of 549.5 for HMM based on sequences of Figure 4
  misc_feature (1)..(304): Functional Homolog Of SEQ ID NO. 2
MKGNRSADQLELPAGFRFHPTDDELVNHYLLKKCGGQSISAPIIAEIDLYKYDPWQLPEMALYGEKEWYFFSPRDRKYPNGSRPNRAAGTGYWKATGADKPIGRPKPLGIKKALVFYAGKAPKGIKTNWIMHEYRLANVDRTAGKKNNLRLDDWVLCRIYNKKGSVEKHFPAERKSIAKYPEMEEQKPNISEMSGYHNGMSQIAAPTMMMSNSNDFLYMDTSDSIPRLNTDSSSSEHVLSPEVTCEKEVQSQPKWNDQLDNAFDFNFNYIDDGFQDYPFASQDQFQLDQLSPLQDMFMYLQKPF

SEQ ID NO: 212 - protein, 284 aa, Chrysanthemum x morifolium
  misc_feature (1)..(284): Public GI ID no. 311976585
  misc_feature (5)..(129): Pfam Name: NAM Pfam Description: No apical meristem (NAM) protein
  misc_feature (1)..(284): Bit score of 481.6 for HMM based on sequences of Figure 4
  misc_feature (1)..(284): Functional Homolog Of SEQ ID NO. 2
MTLELPPGFRFHPNDEELVMHYLIRKCASQSISVPIIADIDLYKFDPWQLPGMALYGEKEWYFFSPRDRKYPNGSRPNRAAGTGYWKATGADKPIGKPKAVGIKKALVFYAGKAPRGVKTNWIMHEYRLANVDRSAGKRSNNLRLDDWVLCRIYNKKGVLEKHLHSDVQSTHMSEMEIETKPKITPYARVSYTSSSHPPLSIPHHVMDDEFNFESSESVLTLHTDSSSEHEREVQSEVKKDDFQFNYMDSFADDAFTPQNQYYNDFQLSPLQDMFMFMPKSYQM

SEQ ID NO: 213 - protein, 336 aa, Malus x domestica
  misc_feature (1)..(336): Public GI ID no. 302399005
  misc_feature (14)..(139): Pfam Name: NAM Pfam Description: No apical meristem (NAM) protein
  misc_feature (1)..(336): Bit score of 349.2 for HMM based on sequences of Figure 4
  misc_feature (1)..(336): Functional Homolog Of SEQ ID NO. 2
MGVPETDPLSQLSLPPGFRFYPTDEELLVQYLCRKVAGYQFNLQIIAEIDLYKFDPWVLPSKAIFGEKEWYFFSPRDRKYPNGSRPNRVAGTGYWKATGTDKVITTEGKKVGIKKALVFYVGKAPKGIKTNWIMHEYRLIEPSRKNGSSKLDEWVLCRIYKKSTSSAAAAAAQKSVTSVSGKEHSNGSSSPCSSQLDDGLEWLPDIDDRFFTLPRINSLKTLQQQDSKLNFQNTGSGNFDWASLAGLNSAAELGLNNQTQQGQGQVNLNYNDNDMFVPSIPSLCHVESRPERVGKTAEEEVQSGLRTQRVDNSGFIQQNSQNFCNPVRPGGFGLWQ

SEQ ID NO: 214 - protein, 331 aa, Vitis vinifera
  misc_feature (1)..(331): Public GI ID no. 297744870
  misc_feature (15)..(142): Pfam Name: NAM Pfam Description: No apical meristem (NAM) protein
  misc_feature (1)..(331): Bit score of 361.2 for HMM based on sequences of Figure 4
  misc_feature (1)..(331): Functional Homolog Of SEQ ID NO. 2
MDSTDSSSGSHHPQLPPGFRFHPTDEELVVHYLKRKAASVPLPVTIIADVDLYKFDPWELPSKATFGEQEWYFFSPRDRKYPNGARPNRAATSGYWKATGTDKPILTSNGSQKVGVKKALVFYGGKPPKGIKTNWIMHEYRLIDSTSSNTKPPGADMGNKKGSLRLDDWVLCRIYKKNISQRPMERDKEESMEALLASLPASSMTSQQNTRAQTLRSTNFGAVLEHEEISFEGMLTGQSIQGLQSSSMSQYWNGAGSIGPSSSGKHLHTDHTSGTSTSEMDGNSSFVSLLNQLPQSGTFHQNTLLGSLADEEKFNLRNINRKKCLRRNKVG

SEQ ID NO: 215 - protein, 289 aa, Arabidopsis thaliana
  misc_feature (1)..(289): Public GI ID no. 15223456
  misc_feature (7)..(131): Pfam Name: NAM Pfam Description: No apical meristem (NAM) protein
  misc_feature (1)..(289): Bit score of 534.9 for HMM based on sequences of Figure 4
  misc_feature (1)..(289): Functional Homolog Of SEQ ID NO. 2
MSELLQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSVRKKKNSLRLDDWVLCRIYNKKGATERRGPPPPVVYGDEIMEEKPKVTEMVMPPPPQQTSEFAYFDTSDSVPKLHTTDSSCSEQVVSPEFTSEVQSEPKWKDWSAVSNDNNNTLDFGFNYIDATVDNAFGGGGSSNQMFPLQDMFMYMQKPY

SEQ ID NO: 216 - protein, 363 aa, Prunus persica
  misc_feature (1)..(363): Public GI ID no. 63252923
  misc_feature (26)..(153): Pfam Name: NAM Pfam Description: No apical meristem (NAM) protein
  misc_feature (1)..(363): Bit score of 390.3 for HMM based on sequences of Figure 4
  misc_feature (1)..(363): Functional Homolog Of SEQ ID NO. 2
MESTDSSTASQQQQQQQPQPPPQPNLPPGFRFHPTDEELVVHYLKKKVTSAPLPVAIIAEIELYKFDPWELPAKATFGEQEWYFFSPRDRKYPNGARPNRAATSGYWKATGTDKPVLTSGGTQKVGVKKALVFYGGKPPKGIKTNWIMHEYRLADSKTSNKPPGCDLGNKKNSLRLDDWVLCRIYKKNNSHRPMDLEREDSMEDMMGPLMPPSISHVGHHQNMNLHLPKSNTNYGPPFIENDQIIFDGIMSSTDGSASLSNGTSQLPLKRSIVPSLYRNDQEDDQTAGASSSKRVVQLHQLDSGTNNSVAANNNSTSIANLLSQLPQTPPLHQHAMLGSLGDGLFRTPYQLPGMNWFSESNLG

SEQ ID NO: 217 - protein, 348 aa, Glycine max
  misc_feature (1)..(348): Public GI ID no. 255636538
  misc_feature (14)..(139): Pfam Name: NAM Pfam Description: No apical meristem (NAM) protein
  misc_feature (1)..(348): Bit score of 362.6 for HMM based on sequences of Figure 4
  misc_feature (1)..(348): Functional Homolog Of SEQ ID NO. 2
MGVPERDPLAQLSLPPGFRFYPTDEELLVQYLCRKVAGHHFSLPIIAEVDLYKFDPWVLPGKAVFGEKEWYFFSPRDRKYPNGSRPNRVAGSGYWKATGTDKIITTEGRKVGIKKALVFYIGKAPKGSKTNWIMREYRLLDSSRKHNLGTAKLDDWVLCRIYKKNSSSQKVEANFLAMECSNGSSPSSSSHVDDMLGSLPEINDRCFTLPRVNSLRTMHQQDEKFGSPNMGSGFFSDWVNSTDLDSISEFESGCQTQRMVNYDCNDFFVPSLPPLGHVDYMVDAPLEEEVQSGVRTRRVDGPGHFQPNPDTRLLPGSGDPIRVWVYYGSAKLGSGLGSEVKVSESGIV

SEQ ID NO: 218 - protein, 194 aa, Solanum demissum
  misc_feature (1)..(194): Public GI ID no. 113205414
  misc_feature (9)..(134): Pfam Name: NAM Pfam Description: No apical meristem (NAM) protein
  misc_feature (1)..(194): Bit score of 241.7 for HMM based on sequences of Figure 4
  misc_feature (1)..(194): Functional Homolog Of SEQ ID NO. 2
MVGKISSDLPPGFRFHPTDEELIMYYLRYQATSRPCPVSIIPEIDVYKFDPWELPEKAEFGENEWYFFTPRDRKYPNGVRPNRAAVSGYWKATGTDKAIYSANKYVGIKKALVFYKGKPPKGVKTDWIMHEYRLSDSKSQTYSKQSGSMRLDDWVLCRIYKKKNLGKTIEMMKVEEEELEAQNPLFVNPTFQSQ

SEQ ID NO: 219 - protein, 199 aa, Solanum demissum
  misc_feature (1)..(199): Public GI ID no. 113205453
  misc_feature (9)..(134): Pfam Name: NAM Pfam Description: No apical meristem (NAM) protein
  misc_feature (1)..(199): Bit score of 250.5 for HMM based on sequences of Figure 4
  misc_feature (1)..(199): Functional Homolog Of SEQ ID NO. 2
MVGKISSDLPPGFRFHPTDEELIMYYLRYQATSRPCPVSIIPEIDVYKFDPWELPEKAEFGENEWYFFTPRDRKYPNGVRPNRAAVSGYWKATGTDKAIYSANKYVGIKKALVFYKGKPPKGVKTDWIMHEYRLSDSKSQTYSKQSGSMRLDDWVLCRIYKKKNLGKTIEMMKVEEEELEAQNIYIYTMYFSDKGIPSR

SEQ ID NO: 220 - protein, 204 aa, Glycine max
  misc_feature (1)..(204): Public GI ID no. 255635167
  misc_feature (14)..(139): Pfam Name: NAM Pfam Description: No apical meristem (NAM) protein
  misc_feature (1)..(204): Bit score of 284.3 for HMM based on sequences of Figure 4
  misc_feature (1)..(204): Functional Homolog Of SEQ ID NO. 2
MGVPEKDPLSQLSLPPGFRFYPTDEELLVQYLCRKVAGHHFSLPIIAEIDLYKFDPWVLPSKAIFGEKEWYFFSPRDRKYPNGSRPNRVAGSGYWKATGTDKIITTEGRKVGIKKALVFYIGKAPKGTKTNWIMHEYRLLDSSRKNTGTKLDDWVLCRIYKKNSSAQKAVQNGVVPSNEHTQYSNGSSSSSSSQLDDVLDRCSD

SEQ ID NO: 221 - protein, 346 aa, Gossypium hirsutum
  misc_feature (1)..(346): Public GI ID no. 206584345
  misc_feature (14)..(139): Pfam Name: NAM Pfam Description: No apical meristem (NAM) protein
  misc_feature (1)..(346): Bit score of 388.1 for HMM based on sequences of Figure 4
  misc_feature (1)..(346): Functional Homolog Of SEQ ID NO. 2
MGVPETDPLAQLSLPPGFRFYPTDEELLVQYLCRKVAGHHFSLQIIGEIDLYKFNPWDLPSKALFGEKEWYFFSPRDRKYPNGSRPNRVAGSGYWKATGTDKIITTEGRKVGIKKALVFYVGKAPKGTKTNWIMHEYRLIETSRKSGSSKLDDWVLCRIYKKNSSGQKPLSSVSSREQSTNGSSSSSSSQLDDMLESLPELDDRFFALPRVNSFKTLQNDVKLGFQSLGIGNLDWGSLGGLSSVPELVPSGQTQTQTQSQGITSYGNSNVYVSTMPPTLCQMDVSTNKIGNSVEEEVQSGLRTQRADNSGIFQQNSNVLNSHNFSNSIDPYGFRCPTQSGGFGFRQ

SEQ ID NO: 222 - DNA, 1208 bp, Arabidopsis thaliana
  misc_feature (1)..(1208): Ceres Annot ID no. 867355
  misc_feature (1)..(1208): Encodes the peptide sequence at SEQ ID NO. 223
gtcaaaaataagaaagaaagaaaaaaatatgggtatccaagaaactgacccgttaacgcaattgagtttaccaccgggtttccgattttacccgaccgatgaagagcttatggttcaatatctctgtagaaaagcagctggttacgatttctctcttcagctcatcgccgaaatagatctttacaaattcgatccatgggttttaccaaataaagcattatttggagaaaaagaatggtatttttttagtcctagggatagaaaatatccaaacgggtcaagacctaaccgggttgccggatcgggttattggaaagctacgggtacggataaaataatctcgacggaaggacaaagagttggtattaaaaaagctttggtgttttacatcggaaaagctcctaaaggtactaaaaccaattggatcatgcatgagtatcgtctcattgaaccttctcgtagaaacggaagcactaagttggatgattgggttctatgtcgaatatacaagaagcaatcaagtgcacaaaaacaagtttacgataatggaatcgcgaatgctagagaattcagcaacaacggtacttcgtccacgacgtcgtcttcttctcactttgaagacgttcttgattcgtttcatcaagagatcgacaacagaaatttccagttttctaacccaaaccgcatctcgtcgctcagaccggacttaaccgaacagaaaaccgggttccacggtcttgcggatacttctaacttcgattgggctagttttgccggtaatgttgagcataataactcggtaccggaactcggaatgagtcatgttgttcctaatctcgagtacaactgtggctacctgaagacggaggaggaagtcgagagcagtcacgggtttaataactcgggcgagttagctcaaaagggttatggtgttgactcgtttgggtattcggggcaagttggtgggtttgggtttatgtgatgatgaaatgctgacgcaataaaaataagtcgttaatttttgtcccgtggcaaatcttatatgtatttgaatttcaattcttttgggttaagagggagactcatagatttagatgtagatttgtaatctttcatgcatagaaaatttgacgaatagatttcgtaactttattttgttgctgtttggttatctttgtattggtataaatttagtggattgaaattgc

SEQ ID NO: 223 - protein, 317 aa, Arabidopsis thaliana
  misc_feature (1)..(317): Ceres Annot ID no. 867355
  misc_feature (14)..(139): Pfam Name: NAM Pfam Description: No apical meristem (NAM) protein
  misc_feature (1)..(317): Bit score of 356.4 for HMM based on sequences of Figure 4
  misc_feature (1)..(317): Functional Homolog Of SEQ ID NO. 2
MGIQETDPLTQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKLDDWVLCRIYKKQSSAQKQVYDNGIANAREFSNNGTSSTTSSSSHFEDVLDSFHQEIDNRNFQFSNPNRISSLRPDLTEQKTGFHGLADTSNFDWASFAGNVEHNNSVPELGMSHVVPNLEYNCGYLKTEEEVESSHGFNNSGELAQKGYGVDSFGYSGQVGGFGFM

SEQ ID NO: 224 - protein, 339 aa, Cicer arietinum
  misc_feature (1)..(339): Public GI ID no. 242877103
  misc_feature (14)..(139): Pfam Name: NAM Pfam Description: No apical meristem (NAM) protein
  misc_feature (1)..(339): Bit score of 361.1 for HMM based on sequences of Figure 4
  misc_feature (1)..(339): Functional Homolog Of SEQ ID NO. 2
MGIQDKDPLSQLSLPPGFRFYPTDEELLVQYLCRKVAGHHFSLQIIAEIDLYKFDPWVLPSKAIFGEKEWYFFSPRDRKYPNGTRPNRVAGSGYWKATGTDKIITNEGRKVGIKKALVFYVGKAPKGTKTNWIMHEYRLLDSSRNNTGTKLDDWVLCRIYKKNSSAQNAIPNGIVSSREYTQYSNDSSASSSSHLDDVLQSLPEIDDRCFMLPRVNSLRTMQHRQEEDKLNLLNLNNNNLMDWSNPSSILNTEFQEGQNNGMVNYSSCNDLYVPSVSTICHVNTSGTEKKPMEEEVQSGGARTNPGLFERGSNNFTYSNSVDSFGFRYPVQPVGFGFGQ

SEQ ID NO: 225 - protein, 176 aa, Selaginella moellendorffii
  misc_feature (1)..(176): Public GI ID no. 302793560
  misc_feature (18)..(143): Pfam Name: NAM Pfam Description: No apical meristem (NAM) protein
  misc_feature (1)..(176): Bit score of 223.0 for HMM based on sequences of Figure 4
  misc_feature (1)..(176): Functional Homolog Of SEQ ID NO. 2
MDSGGKPRTAPPSEQLNLPAGFRFHPTDEELVVSYLAIKAESRPFAIPIIAEIDLYKFDPWELPEKALFGEREWYFFSPRDRKYPNGARPNRAAASGYWKATGTDKPILSKGKKVGVKKALVFYKGKAPKGSKTNWIMHEYRLADSSAKAAAAIPAMRKKGSLRLDDWVLCRIYKK

SEQ ID NO: 226 - DNA, 1239 bp, Arabidopsis thaliana
  misc_feature (1)..(1239): Ceres Clone ID no. 38344
  misc_feature (1)..(1239): Encodes the peptide sequence at SEQ ID NO. 227
aaaagatcgacgaacataaaaacaaaaacatataatttgggtttttagagttcgaaacttgaaatctttttttttttttggttgctgaggaatcgaagtagaagagtataaatgggtgttagagagaaagatccgttagcccagttgagtttgccaccgggttttagattttatccgacagatgaagagcttcttgttcagtatctatgtcggaaagttgcaggctatcatttctctctccaggtcatcggagacatcgatctctacaagttcgatccttgggatttgccaagtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactccggttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatgagagagatgtgaagttactgatgggtgaaaaaagtaaaaacaaaacttggagatagtagagtggcaattgatgtaaataatagggatttatatgggcttttaccgattcggtgaggcttaggattccacaaaggaaaaaggctcgactggagactagtttgatccaacttgacggcccgcaaatgtataatgtttctcaatggagaaaaaaataaatggttaccaatatttttac

SEQ ID NO: 227 - protein, 297 aa, Arabidopsis thaliana
  misc_feature (1)..(297): Ceres Clone ID no. 38344
  misc_feature (14)..(139): Pfam Name: NAM Pfam Description: No apical meristem (NAM) protein
  misc_feature (1)..(297): Bit score of 350.0 for HMM based on sequences of Figure 4
  misc_feature (1)..(297): Functional Homolog Of SEQ ID NO. 2
MGVREKDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 228 - protein, 300 aa, Brassica napus
  misc_feature (1)..(300): Public GI ID no. 31322582
  misc_feature (14)..(139): Pfam Name: NAM Pfam Description: No apical meristem (NAM) protein
  misc_feature (1)..(300): Bit score of 350.2 for HMM based on sequences of Figure 4
  misc_feature (1)..(300): Functional Homolog Of SEQ ID NO. 2
  misc_feature (191)..(191): Xaa is any aa, unknown or other
  misc_feature (255)..(255): Xaa is any aa, unknown or other
MGVREKDPLAQLSLPPGFRFYPTDEELLVQYLCRKVAGYHFSLQIIGDIDLYKFDPWDLPSKALFGEKEWYFFSPRDRKYPNGSRPNRVAGSGYWKATGTDKIIMSDGHRVGIKKALVFYAGKAPKGTKTNWIMHEYRLIEHSRSHGSSKLDDWVLCRIYKKTSGSQRQAVASPVQACLEDQSTNMSSSPXSSSQLDDVLDSFPEMKDRSFDLPRMNSLRTILNGNFEWASLAGLNPMPELAPMTYGLSNYGGYXAFQSAESGCRSSQVDQEQNSTELTQSLGYSSSGFGLSGQMYEFRQ

SEQ ID NO: 229 - protein, 383 aa, Aegilops tauschii
  misc_feature (1)..(383): Public GI ID no. 115336269
  misc_feature (28)..(156): Pfam Name: NAM Pfam Description: No apical meristem (NAM) protein
  misc_feature (1)..(383): Bit score of 359.0 for HMM based on sequences of Figure 4
  misc_feature (1)..(383): Functional Homolog Of SEQ ID NO. 2
MGSSDSSSGSAPPRHQPPPPQQGSAPELPPGFRFHPTDEELVVHYLKKKAAKVPLPVTIIAEVDLYKFDPWELPEKATFGEQEWYFFSPRDRKYPNGARPNRAATSGYWKATGTDKPIMASGCGREKVGVKKALVFYRGKPPKGLKTNWIMHEYRLTDASSSATTSRPPPVTGGSRAASLRLDDWVLCRIYKKINKAAAGDQQRSMECEDSVEDAVTAYPPYATAGMTGAGAHGSNYDSLLHHQDSHEDNFLDGLLTAEDAGLSAGATSLSHLAAAARASPAPTKQFLAPSSSTPFNWLDASTVGILPQARNFPGFNRSRNVGNMSLSSTADMAVDNGGGNAINAMPPFMNHLPVQDGTYHQQHVILGAPLAPEATAAATSAF

SEQ ID NO: 230 - protein, 355 aa, Bambusa emeiensis
  misc_feature (1)..(355): Public GI ID no. 311115260
  misc_feature (9)..(136): Pfam Name: NAM Pfam Description: No apical meristem (NAM) protein
  misc_feature (1)..(355): Bit score of 325.9 for HMM based on sequences of Figure 4
  misc_feature (1)..(355): Functional Homolog Of SEQ ID NO. 2
MIMQNPAMLPPGFRFHPTDEELILHYLRNRAGSSPCPVAIIADVDIYKFDPWDLPSKAAYGDKEWYFFSPRDRKYPNGIRPNRAAGSGYWKATGTDKPIHNSATGESLGVKKALVFYTGRPPKGTKTNWIMHEYRLTSADAQAGNTYRPMKFRNASMRLDDWVLCRIYKKSSHVSPMAVPPLSDHELDEPCAFEENQLYGKSSAGMIMQGGADAFPLQAAAATQRMPRIPSISELLNDYSLAQLLDDGAPAEMARPDQRAALLGHPVVNQFLVNSSGNMSQLAQMGSSAAGEGATGKRKRSEDGGSTGLPSQPAAAAQKPNYSCFGATFHQIGNGLQGSLGLDHQMLLHSNMGMN

SEQ ID NO: 231 - protein, 176 aa, Physcomitrella patens
  misc_feature (1)..(176): Public GI ID no. 168054147
  misc_feature (1)..(176): Physcomitrella patens subsp. patens
  misc_feature (12)..(139): Pfam Name: NAM Pfam Description: No apical meristem (NAM) protein
  misc_feature (1)..(176): Bit score of 228.6 for HMM based on sequences of Figure 4
  misc_feature (1)..(176): Functional Homolog Of SEQ ID NO. 2
METTGSLAQLQLPPGFRFHPTDEELVLHYLRRKADSHVFLIPVIAEVDLYKFDPWDLPDKALFGEREWYFFSPRDRKYPNGARPNRAAASGYWKATGTDKPIFMTNSHSKVGVKKALVFYRGKAPKGEKTNWIMHEYRLAEGVSPPARHHRRGSLRLDDWVLCRIYEKCTHAQRAG

SEQ ID NO: 232 - protein, 355 aa, Bambusa emeiensis
  misc_feature (1)..(355): Public GI ID no. 311115262
  misc_feature (9)..(136): Pfam Name: NAM Pfam Description: No apical meristem (NAM) protein
  misc_feature (1)..(355): Bit score of 331.2 for HMM based on sequences of Figure 4
  misc_feature (1)..(355): Functional Homolog Of SEQ ID NO. 2
MIMPSPAMLPPGFRFHPTDEELILHYLRNRAGSSPCPVAIIADVDIYKFDPWDLPSKAAYGDKEWYFFSPRDRKYPNGIRPNRAAGSGYWKATGTDKPIHNSATGESLGVKKALVFYTGRPPKGNKTNWIMHEYRLASADAQAGNTYRPMKFRNASMRLDDWVLCRIYKKSSHVSPMAVPPRSDHELDEPCAFEENQLYGKSSAGMIMQGGADAFPLQAAAATQRMPRIPSISELLNDYSLAQLLDDGAPAEMARPDQRAALLGHPVVNQFLVNSSGNMSQLAQMGSSAAGEGATGKRKRSEDGGSTGLPSQPAAAAQKPNYSCFGATFHQIGNGLQGSLGLDHQMLLHSNMGMN

SEQ ID NO: 233 - protein, 207 aa, Physcomitrella patens
  misc_feature (1)..(207): Public GI ID no. 168034283
  misc_feature (1)..(207): Physcomitrella patens subsp. patens
  misc_feature (12)..(139): Pfam Name: NAM Pfam Description: No apical meristem (NAM) protein
  misc_feature (1)..(207): Bit score of 283.9 for HMM based on sequences of Figure 4
  misc_feature (1)..(207): Functional Homolog Of SEQ ID NO. 2
METGGSISQLQLPPGFRFHPTDEELVLHYLRRKADSHVFQIPVIAEVNLYKFDPWDLPDKALFGEREWYFFSPRDRKYPNGARPNRAAASGYWKATGTDKPIHMTNGHSKVGVKKALVFYRGKAPKGEKTNWIMHEYRLAEGVSPSAHHHRRGSLRLDDWVLCRIYEKCTHAQRAGKEHDRASVEDVLASLPEIDDPNHMLPRLNSM

SEQ ID NO: 234 - protein, 256 aa, Phaseolus vulgaris
  misc_feature (1)..(256): Public GI ID no. 15148914
  misc_feature (9)..(134): Pfam Name: NAM Pfam Description: No apical meristem (NAM) protein
  misc_feature (1)..(256): Bit score of 304.0 for HMM based on sequences of Figure 4
  misc_feature (1)..(256): Functional Homolog Of SEQ ID NO. 2
MDATTPSELPPGFRFHPTDEELIVYYLCNQATSKPCPASIIPEVDLYKFDPWELPDKTEFGENEWYFFSPRDRKYPNGVRPNRATVSGYWKATGTDKAIYSGSKLVGVKKSLVFYKGRPPKGDKTDWIMHEYRLAESKQPVNRKIGSMRLDDWVLCRIYKKKNTGKTLEHKETHPKVQMTNLIAANNDEQKMMNLPRTWSLTYLLDMNYLGPILSDGSYCSTFDFQISNANIGIDPFVNSQPVEMANNYVSDSGKY

SEQ ID NO: 235 - protein, 189 aa, Selaginella moellendorffii
  misc_feature (1)..(189): Public GI ID no. 302767458
  misc_feature (31)..(159): Pfam Name: NAM Pfam Description: No apical meristem (NAM) protein
  misc_feature (1)..(189): Bit score of 198.5 for HMM based on sequences of Figure 4
  misc_feature (1)..(189): Functional Homolog Of SEQ ID NO. 2
MELDQHCSTGEQNQQHLSSDQASGSSDQLQLPPGFRFHPTDEELVVHYLSRKLASHSFKPLPIVTEVDLYKFDPWELPQQASFGEKEWYFFSPRDRKYPNGVRPNRAAASGYWKATGTDKMIHSSADGRKIGVKKALVFYKGRAPKGAKSNWIMHEYRLVDPNNKALFARKRGSLRLDDWVLCRIYKKK

SEQ ID NO: 236 - DNA, 831 bp, Arabidopsis thaliana
  misc_feature (1)..(831): Ceres Clone ID no. 11684
  misc_feature (1)..(831): Encodes the peptide sequence at SEQ ID NO. 237
aggcccatattccattcttacctctctctacctctctatctctctctcctcataatcgatccgtaaactcgccggaggagcagggagattcaataagacgatggctcagagaacggagaaggaagagaccgagttcaaagttctcgaaaccttgacgacaacaacaacgacgttatgtaccaataactgcggcgttacagcgaatcctgcgacgaacaacatgtgtcagaaatgtttcaacgcatctctcgtctcggcggccgcaggtgttgttgaatcaggttcgatcttgaagagatcggctagatctgtcaatcttcgttcgtcaccagctaaagtcgtgattcgtccaagagagatcgatgcggtgaagaagagagatcaacagatcgtaaaccgatgttctggttgtcggaagaaagttgggttgaccggattcaggtgccgatgcggtgagcttttctgctcagagcaccgttactccgatcgtcatgattgtagctacgactacaaaaccgctggtcgtgaggcgatcgctagagaaaatccggtggtcaaggctgcgaaaatggtcaaagtttaaaaaattaaaaattcgatctcaaccgttgaaaaacttgtggtggttcaaaagctccgatcggaagagagattggtcggagagacatggatttgatttggtgatgtgttgtaaaagaagatcagagagattattcctctcctcaaatcaaaatctgaacctcaattttttttttttacgtttttttttcatcttttaatttatatattagtgaatgattattaatattattattgtgtggcttacggatt

SEQ ID NO: 237 - protein, 160 aa, Arabidopsis thaliana
  misc_feature (1)..(160): Ceres Clone ID no. 11684
  misc_feature (101)..(140): Pfam Name: zf-AN1 Pfam Description: AN1-like Zinc finger
  misc_feature (25)..(47): Pfam Name: zf-A20 Pfam Description: A20-like zinc finger
  misc_feature (1)..(160): Bit score of 282.2 for HMM based on sequences of Figure 2
  misc_feature (1)..(160): in Figure 2
MAQRTEKEETEFKVLETLTTTTTTLCTNNCGVTANPATNNMCQKCFNASLVSAAAGVVESGSILKRSARSVNLRSSPAKVVIRPREIDAVKKRDQQIVNRCSGCRKKVGLTGFRCRCGELFCSEHRYSDRHDCSYDYKTAGREAIARENPVVKAAKMVKV

SEQ ID NO: 238 - DNA, 857 bp, Gossypium hirsutum
  misc_feature (1)..(857): Ceres Clone ID no. 1847516
  misc_feature (1)..(857): Encodes the peptide sequence at SEQ ID NO. 239
atacgcgtctctatgaggcccatattccgtcgccattactgaccgacctttctcgaccccttcaaatcccctctctctctctctctccttaattccaacgccaacgccccctaattttctctccaaccaaacactcattctctccttcctctctatcctccccttcaaatttgttgttttccttttcctccttcgaaatcagctcaaggagatatggctcaaagaaccgaaaaagaagagactgaattcaaagtccctgaaaccctgacgctatgcgttaacaactgcggggttacgggtaatccagccaccaacaacatgtgccagaagtgttttagtgccaccacggccgcaacatcctcctcttcctcttcctcttccaccaacaacaccgctacttccgctaccgacgataaatcctcgagatctacgccgactcgttcacaggacaatcgatccgattccgctccacctacaacagctgcaacaacggcaacagcaacgacgaatagtccgatgaccgcttcaaatcggtctggatacgataccgcggaaaagaagtcggtgaatcgatgttctggttgcagaaaacgcgttgggttgaccgggttccggtgtcgatgcggggagcttttctgttcggaccatcggtactcggatcgacacgattgtagctacgactacaaggcggcgggtcgcgaagccatcgctagagaaaatcccgtggttaaagcagccaagattatcagagtttgagtttttaccaaatggatccaaattaaattaaataaactattcaaaacatttttcgacctgaaaatagcaagttgtggagatctatgctcgatctcaaatgg

SEQ ID NO: 239 - protein, 180 aa, Gossypium hirsutum
  misc_feature (1)..(180): Ceres Clone ID no. 1847516
  misc_feature (121)..(160): Pfam Name: zf-AN1 Pfam Description: AN1-like Zinc finger
  misc_feature (20)..(41): Pfam Name: zf-A20 Pfam Description: A20-like zinc finger
  misc_feature (1)..(180): Bit score of 308.9 for HMM based on sequences of Figure 2
  misc_feature (1)..(180): Functional Homolog Of SEQ ID NO. 237
  misc_feature (1)..(180): in Figure 2
MAQRTEKEETEFKVPETLTLCVNNCGVTGNPATNNMCQKCFSATTAATSSSSSSSSTNNTATSATDDKSSRSTPTRSQDNRSDSAPPTTAATTATATTNSPMTASNRSGYDTAEKKSVNRCSGCRKRVGLTGFRCRCGELFCSDHRYSDRHDCSYDYKAAGREAIARENPVVKAAKIIRV

SEQ ID NO: 240 - DNA, 531 bp, Sorghum bicolor
  misc_feature (1)..(531): Ceres Annot ID no. 8714481
  misc_feature (1)..(531): Encodes the peptide sequence at SEQ ID NO. 241
atggcgcagcgcgacaagaaggtggaggagccgacggagctgcgggcgccggagctcacgctgtgcgccaacagctgcggcttcccggggaacccggccaccaacaacctctgccaggcctgcttccaggccgccacggcttcctccgcctcagcctccgtctcgccgccgtcgccttcctcctcgttgtctccgtccccggcggtgttcaagttcgacgagcagcagcacgcgaggccgtctgcgacggcggtgttcgccgaccggcctgcggagcaaccgccggcgccggcgtccgccaggccgatccggacgacgtcgacttcgtcgtcgtcgtccgtcaaccggtgccagagctgccggaagcgcgtcgggctgacggggttccggtgccgctgcggggagctcttctgcggcgcgcaccgctactcggaccgccacgactgctgcttcgactacaaggccgtcggcagggacgccatcgccagggagaaccccgtcgtgcgcgccgccaagatcgtcaggttctga

SEQ ID NO: 241 - protein, 176 aa, Sorghum bicolor
  misc_feature (1)..(176): Ceres Annot ID no. 8714481
  misc_feature (117)..(155): Pfam Name: zf-AN1 Pfam Description: AN1-like Zinc finger
  misc_feature (21)..(43): Pfam Name: zf-A20 Pfam Description: A20-like zinc finger
  misc_feature (1)..(176): Bit score of 272.8 for HMM based on sequences of Figure 2
  misc_feature (1)..(176): Functional Homolog Of SEQ ID NO. 237
  misc_feature (1)..(176): in Figure 2
MAQRDKKVEEPTELRAPELTLCANSCGFPGNPATNNLCQACFQAATASSASASVSPPSPSSSLSPSPAVFKFDEQQHARPSATAVFADRPAEQPPAPASARPIRTTSTSSSSSVNRCQSCRKRVGLTGFRCRCGELFCGAHRYSDRHDCCFDYKAVGRDAIARENPVVRAAKIVRF

SEQ ID NO: 242 - DNA, 1133 bp, Panicum virgatum
  misc_feature (1)..(1133): Ceres Clone ID no. 1961986
  misc_feature (1)..(1133): Encodes the peptide sequence at SEQ ID NO. 243
ttgcctttgcccgctgcgcttgcgcgtccgcggaaggggacgacgacgcgtccccgtctcctccccttccccgataaaaaggccgggcgcctctcgttcattcctcgctcatcgccgatcacaaccgcgccctccccccaatccccgattcgcgagctcgtccgcgcctcccggcctctcctccccacccccacccgccgcccctccgagaagcgaagcgaagctccgggccgcgccaccgcgcaggcaggcacccaaggcagcaggcgcgggttccttccgccaggtgcgcgggtaggcggcggcatggcgcagcgcgacaagaaggaggagcccacggagctccgggcgccggagatcacgctctgcgccaacaactgcggcttcccggggaacccggccacgcagaacctctgccagagctgcttctcggcggccacggcgtcgatgtcgtcgtcgccgacgtcctcctcgtcgtcctccacggccccggcgccggccgcgccgccccagccgaggccggcgccggcggagctggcctcccccgccgacgcggccgtggcggccccggctccggaggccgcgaaggcgccggcgaggacgtcggcgaaccggtgctcgagctgccggaagcgggtggggctgacggggttccggtgccggtgcggcgagctgttctgcggcgcgcaccggtactcggaccggcacggctgcagctacgactacaagggcgccgccagggacgccatcgcccgggagaacccggtggtgcgcgccgccaagatcgttaggttctgatcgacgacggagtcaaaattcctccatccatccacaggatcaagcaagcgaggaagacaaagaggaagcacacatccacggaaatggaaggccttttcccttggtgttactatgctgttcttcgaagcgtttgattttcaatctcctttttctttttacgatttctcaaatggaagaaaaaatgggaggaaaagaggtggacaaggaatagtgtaataataatgggggcaatgaggccgcggcggtggttgagagcaaaaggatcaacgcaatggattgggtgtatgtacctgtcacacgcaagctttgtgcaaaaactattatacatttctatc

SEQ ID NO: 243 - protein, 163 aa, Panicum virgatum
  misc_feature (1)..(163): Ceres Clone ID no. 1961986
  misc_feature (104)..(143): Pfam Name: zf-AN1 Pfam Description: AN1-like Zinc finger
  misc_feature (20)..(41): Pfam Name: zf-A20 Pfam Description: A20-like zinc finger
  misc_feature (1)..(163): Bit score of 277.2 for HMM based on sequences of Figure 2
  misc_feature (1)..(163): Functional Homolog Of SEQ ID NO. 237
  misc_feature (1)..(163): in Figure 2
MAQRDKKEEPTELRAPEITLCANNCGFPGNPATQNLCQSCFSAATASMSSSPTSSSSSSTAPAPAAPPQPRPAPAELASPADAAVAAPAPEAAKAPARTSANRCSSCRKRVGLTGFRCRCGELFCGAHRYSDRHGCSYDYKGAARDAIARENPVVRAAKIVRF

SEQ ID NO: 244 - DNA, 609 bp, Brassica napus
  misc_feature (1)..(609): Ceres Clone ID no. 1464596
  misc_feature (1)..(609): Encodes the peptide sequence at SEQ ID NO. 245
atattccattcatttcctttctctctctctcttctctcgcttttatctctctatattctcaattcgtaagctcgccggagaacgtgaaaaacaatatacatggcgcagagaacggagaaggaagagacggagttcaaggtcctcgaaaccttgaccaccaccccaacgctctgctcaaacaactgcggcgttacagcgaatccagcgaccaacaacatgtgtcagaaatgtttcaacgcctccgtcgccgccgccggcgtagactcaacctcgatcttgaagagatcagccagatccgtcaaccttcgatcgacgccagccaaagtcgtgattcgtcccagggagatcgacccggttaagagagatcaacagacgataaaccggtgttccggttgtcgtaagaaggtcggtttgaccgggttcagatgccgatgcggcgatcttttctgcgccgagcaccgttactcggatcgccacgattgcagctacgactacaaaaccgccggacgcgaggcgatcgccagagagaatccggtcgtcaaggcggcgaagatagtcaaagtttaaagtttaattcaaatcgattcaatcgtgaaaacttgtggtggt

SEQ ID NO: 245 - protein, 155 aa, Brassica napus
  misc_feature (1)..(155): Ceres Clone ID no. 1464596
  misc_feature (96)..(135): Pfam Name: zf-AN1 Pfam Description: AN1-like Zinc finger
  misc_feature (22)..(46): Pfam Name: zf-A20 Pfam Description: A20-like zinc finger
  misc_feature (1)..(155): Bit score of 283.8 for HMM based on sequences of Figure 2
  misc_feature (1)..(155): Functional Homolog Of SEQ ID NO. 237
  misc_feature (1)..(155): in Figure 2
MAQRTEKEETEFKVLETLTTTPTLCSNNCGVTANPATNNMCQKCFNASVAAAGVDSTSILKRSARSVNLRSTPAKVVIRPREIDPVKRDQQTINRCSGCRKKVGLTGFRCRCGDLFCAEHRYSDRHDCSYDYKTAGREAIARENPVVKAAKIVKV

SEQ ID NO: 246 - protein, 150 aa, Vitis vinifera
  misc_feature (1)..(150): Public GI ID no. 225450173
  misc_feature (91)..(130): Pfam Name: zf-AN1 Pfam Description: AN1-like Zinc finger
  misc_feature (20)..(41): Pfam Name: zf-A20 Pfam Description: A20-like zinc finger
  misc_feature (1)..(150): Bit score of 292.0 for HMM based on sequences of Figure 2
  misc_feature (1)..(150): Functional Homolog Of SEQ ID NO. 237
  misc_feature (1)..(150): in Figure 2
MAQKTEKEETEFKVPETLALCVNNCGFTGNPATNNMCQKCFSASASAAAAAAAGALKSSHKVSGGAADARSSSARSPERMDSLVKREVNRCSGCRRKVGLTGFRCRCGDLFCAEHRYTDRHECSYDYKTAGREAIARENPVVKAAKIVRV

SEQ ID NO: 247 - DNA, 802 bp, Glycine max
  misc_feature (1)..(802): Ceres Clone ID no. 532446
  misc_feature (1)..(802): Encodes the peptide sequence at SEQ ID NO. 248
atagttttccttctttctttctttgtgaaaaaacaaaaagtccaaaccatggctcagaaaaccgagaaagaagaaaccgacttcaaggttcccgaaacgattacgctttgcgttaacaactgcggcgtcaccggaaaccctgctacgaataacatgtgtcagaagtgcttcaccgccttcaccacctctaccgccaccacgtccggcgccggaggtgccggaatagcttctccggctaccagatccggcatctccgcgcgtccactgaagagatcttttcccgaggagccctcgccgccggcggatcctccgtcttcagaccagacgaccccgtcggaggcgaagcgcgtggtgaaccgctgctccggctgcaggaggaaggtcggactcaccggatttcggtgccgatgcggcgagctcttctgcgccgagcaccggtactccgaccgccacgactgcagctacgactacaaagccgccggaagagaagccatcgcgagggagaatccggtgattagagccgcgaagatcgtcaaagtctgaaaaaaaacaaaaaagaaggaaaaaacccgaacggaacggaatctcaaaacgacgtcgttgacggttgacctttcgcgcgatcgggttcaggtcacgggtttcgctttttttcttttcagatttatatatagagagaagaaaaaaaaagtagcagataacaggtttgagagagagagagagagagtgtgaggttttagattgagagagagagcgagagagagagattgttgctgaaaagaagatgaagaagaatttatcc

SEQ ID NO: 248 - protein, 164 aa, Glycine max
  misc_feature (1)..(164): Ceres Clone ID no. 532446
  misc_feature (105)..(144): Pfam Name: zf-AN1 Pfam Description: AN1-like Zinc finger
  misc_feature (20)..(41): Pfam Name: zf-A20 Pfam Description: A20-like zinc finger
  misc_feature (1)..(164): Bit score of 304.7 for HMM based on sequences of Figure 2
  misc_feature (1)..(164): Functional Homolog Of SEQ ID NO. 237
  misc_feature (1)..(164): in Figure 2
MAQKTEKEETDFKVPETITLCVNNCGVTGNPATNNMCQKCFTAFTTSTATTSGAGGAGIASPATRSGISARPLKRSFPEEPSPPADPPSSDQTTPSEAKRVVNRCSGCRRKVGLTGFRCRCGELFCAEHRYSDRHDCSYDYKAAGREAIARENPVIRAAKIVKV

SEQ ID NO: 249 - DNA, 483 bp, Populus trichocarpa
  misc_feature (1)..(483): Ceres Annot ID no. 1493109
  misc_feature (1)..(483): Encodes the peptide sequence at SEQ ID NO. 250
atggctcaaagaacagagaaagaagagaccgagtgcaaggtaccagaaaacttgactttatgtatcaataattgtggagttacaggtaatccagcaacaaacaacatgtgtcagaaatgtttcaacgctacaacaaccaacggtgtgtctaccaacgagatcttaaaattcaccagcgagaaatcgttgagatccagcatatctcgctcgccggcgaaggatcatcaaaggcaaccaaaaactgcgtcggataaagaaagatctgacagttcttccgtggcgaagaaagaggtgaacaggtgctcagggtgccgacgaagggtagggttgaccggattccgatgtcgttgcggggagcttttttgctgggagcaccggtactcagatcgacatgattgtagttacgattacaaaactgtaggtcgcgaagctatcgcgagagagaatcctgttgtgaaagctgcaaagattgttagagtttga

SEQ ID NO: 250 - protein, 160 aa, Populus trichocarpa
  misc_feature (1)..(160): Ceres Annot ID no. 1493109
  misc_feature (101)..(139): Pfam Name: zf-AN1 Pfam Description: AN1-like Zinc finger
  misc_feature (20)..(42): Pfam Name: zf-A20 Pfam Description: A20-like zinc finger
  misc_feature (1)..(160): Bit score of 299.4 for HMM based on sequences of Figure 2
  misc_feature (1)..(160): Functional Homolog Of SEQ ID NO. 237
  misc_feature (1)..(160): in Figure 2
MAQRTEKEETECKVPENLTLCINNCGVTGNPATNNMCQKCFNATTTNGVSTNEILKFTSEKSLRSSISRSPAKDHQRQPKTASDKERSDSSSVAKKEVNRCSGCRRRVGLTGFRCRCGELFCWEHRYSDRHDCSYDYKTVGREAIARENPVVKAAKIVRV

SEQ ID NO: 251 - protein, 188 aa, Solanum lycopersicum
  misc_feature (1)..(188): Public GI ID no. 88866527
  misc_feature (129)..(168): Pfam Name: zf-AN1 Pfam Description: AN1-like Zinc finger
  misc_feature (21)..(43): Pfam Name: zf-A20 Pfam Description: A20-like zinc finger
  misc_feature (1)..(188): Bit score of 302.0 for HMM based on sequences of Figure 2
  misc_feature (1)..(188): Functional Homolog Of SEQ ID NO. 237
  misc_feature (1)..(188): in Figure 2
MAQRTEKEETEFKAVPETITLCINNCGVTGNPATNNMCQKCFNATTAATSTSSSSPTGTSVTIPHNFAEKLVRSEKSARFSSLRSSPDRKSDLDRMSQDLKKVGDTMMVKEEDQLKASLPPAKREVNRCSGCRRKVGLTGFRCRCGELFCGEHRYSDRHDCSYDYKTAGREAIARENPVVKAAKIIKV

SEQ ID NO: 252 - DNA, 733 bp, Parthenium argentatum
  misc_feature (1)..(733): Ceres Clone ID no. 1609861
  misc_feature (1)..(733): Encodes the peptide sequence at SEQ ID NO. 253
aaaaaaaacctccccaccccccacacccaacaaaaaaacaaattcaaactaatcattcaatcaaatactaattattcatttcttgcacgccaagatcttgttaaatctcctcacatctatctataatccctacagcttgttattccacaacaattgattttcttcttataatttcaattctaaatcacaacaaaaaaaaaaaaaaatggctcagagaacagaaaaagaagaaacagaattcaaacctgtacctgaaaccctaactctctgcatcaacaactgcggcgtcgtcggagctccggcgacgaataatatgtgtcaaaactgcttcaccgccaccacaacgtcgcatcgaactcgtactagatctagctcgctgacgtcaccgtctcgtcgtgacgtaaccgtagatctggtgttagatccgacggttgtggtgataggtgatgaattgaaggaagctgtggtggtggtgaagaaggaggtgagtcggtgctctggatgcaggaaacgagtcggtttgaccgggtttcggtgtcggtgtggagatctatattgttcggagcatcggtactctgatcggcatgattgtagttatgattataaggctgttggtcgtgaagtgattgctagggataatccggtggttaaggcggctaaaattgtgaggatatgaatttgcgagcgcacgtttgtcttctgtttcgatgtaattttatttgaagattgatgt

SEQ ID NO: 253 - protein, 156 aa, Parthenium argentatum
  misc_feature (1)..(156): Ceres Clone ID no. 1609861
  misc_feature (97)..(135): Pfam Name: zf-AN1 Pfam Description: AN1-like Zinc finger
  misc_feature (21)..(42): Pfam Name: zf-A20 Pfam Description: A20-like zinc finger
  misc_feature (1)..(156): Bit score of 288.1 for HMM based on sequences of Figure 2
  misc_feature (1)..(156): Functional Homolog Of SEQ ID NO. 237
  misc_feature (1)..(156): in Figure 2
MAQRTEKEETEFKPVPETLTLCINNCGVVGAPATNNMCQNCFTATTTSHRTRTRSSSLTSPSRRDVTVDLVLDPTVVVIGDELKEAVVVVKKEVSRCSGCRKRVGLTGFRCRCGDLYCSEHRYSDRHDCSYDYKAVGREVIARDNPVVKAAKIVRI

SEQ ID NO: 254 - DNA, 586 bp, Papaver somniferum
  misc_feature (1)..(586): Ceres Clone ID no. 1620215
  misc_feature (1)..(586): Encodes the peptide sequence at SEQ ID NO. 255
atctccaaaacaatcaaaaatctgcaaaaaaaaaaaaaatcatttctcaaattctactcagattcatggctcagagagataaagaagaaacagaaatgaaggtttctgaatccttatcactttgcatcaacaactgtggtttctcaggtaatccggctaccaagaacatgtgtcaaagttgttacaaaatttctaccgggattatgacacaaccggctctgacgttttccggcaaagaaaaggctagatctagctttctgaggttgccggagcgatcggattatcaacgacgagatctgattacgcaggatgataagaaaggaattgatgatgatcaagcgaagaatgattcgacgacaattaagattgttgagaagaagcaagaggtgaatcggtgttcaggttgccggaggaaagtaggattgaccggatttagatgtcggtgcggtgatatgttctgttcggaacatagatattccgatcgacatgactgtagttttgattataaagctgctggtagagagagtattgctcgccagaatcctgtcgttaaagctgctaagattattagactctaaattaatgt

SEQ ID NO: 255 - protein, 170 aa, Papaver somniferum
  misc_feature (1)..(170): Ceres Clone ID no. 1620215
  misc_feature (111)..(150): Pfam Name: zf-AN1 Pfam Description: AN1-like Zinc finger
  misc_feature (18)..(41): Pfam Name: zf-A20 Pfam Description: A20-like zinc finger
  misc_feature (1)..(170): Bit score of 280.9 for HMM based on sequences of Figure 2
  misc_feature (1)..(170): Functional Homolog Of SEQ ID NO. 237
  misc_feature (1)..(170): in Figure 2
MAQRDKEETEMKVSESLSLCINNCGFSGNPATKNMCQSCYKISTGIMTQPALTFSGKEKARSSFLRLPERSDYQRRDLITQDDKKGIDDDQAKNDSTTIKIVEKKQEVNRCSGCRRKVGLTGFRCRCGDMFCSEHRYSDRHDCSFDYKAAGRESIARQNPVVKAAKIIRL

SEQ ID NO: 256 - DNA, 753 bp, Musa acuminata
  misc_feature (1)..(753): Ceres Clone ID no. 1732772
  misc_feature (1)..(753): Encodes the peptide sequence at SEQ ID NO. 257
agagttgtatttcttcacgccctcacgattcacagatccggataccaaatcttagaacgagaaggtgaaaagggtaggaatcgatggctcagcgtgagaaggaggaggcgaagctccacgcccccgagaccctcaccctctgcgtcaacaactgcggcttccccggcaaccccgccaccaacaacatgtgccagtcctgcttccaagcttccaccatcgctgcctcccccgctccccactcctgctctccaagatccgctctcccgatccgatcgccggaacgagcggcagaggagcgggacgcgaggacctccgaggcccccgcggcggctgtgtctgccccggcgccggcgcgacaggtgagccggtgcttctcctgccggaagcgtgtggggctcacggggttccggtgccgctgcggcgatctgttctgcggcgagcaccgctactccgatcgccacgactgcagctacgactacaaggccgccgcccgggtcgccatcgctcgcgcgaatcccgtcgtccgagcggccaagatcgtcagggtgtgaagcgaagaaccggggagacgcgtgtgtgtcttgctttccgatctcggaacatcaagttctaaaacggcggaagggaaagcagcaaactgactcatgctttctgctgtgtgtcatcaagaatctggaaatttccccttcctctcttccgtgtgattcggttgtgatttgtttttctttcccagctttgtttctttcatcatgt

SEQ ID NO: 257 - protein, 155 aa, Musa acuminata
  misc_feature (1)..(155): Ceres Clone ID no. 1732772
  misc_feature (96)..(135): Pfam Name: zf-AN1 Pfam Description: AN1-like Zinc finger
  misc_feature (19)..(41): Pfam Name: zf-A20 Pfam Description: A20-like zinc finger
  misc_feature (1)..(155): Bit score of 273.7 for HMM based on sequences of Figure 2
  misc_feature (1)..(155): Functional Homolog Of SEQ ID NO. 237
  misc_feature (1)..(155): in Figure 2
MAQREKEEAKLHAPETLTLCVNNCGFPGNPATNNMCQSCFQASTIAASPAPHSCSPRSALPIRSPERAAEERDARTSEAPAAAVSAPAPARQVSRCFSCRKRVGLTGFRCRCGDLFCGEHRYSDRHDCSYDYKAAARVAIARANPVVRAAKIVRV

SEQ ID NO: 258 - protein, 165 aa, Phyllostachys praecox
  misc_feature (1)..(165): Public GI ID no. 295148935
  misc_feature (106)..(144): Pfam Name: zf-AN1 Pfam Description: AN1-like Zinc finger
  misc_feature (20)..(41): Pfam Name: zf-A20 Pfam Description: A20-like zinc finger
  misc_feature (1)..(165): Bit score of 282.4 for HMM based on sequences of Figure 2
  misc_feature (1)..(165): Functional Homolog Of SEQ ID NO. 237
  misc_feature (1)..(165): in Figure 2
MAQRDKKEEPTELRAPEITLCANGCGFPGNPATQNLCQNCFSAASASTSSPPSPSSSSSSSSSSSLPGLSPVVDKPRPAPVELASPAVDRAPAVEVKAGKTSVNRCSSCRKRVGLTGFRCRCGELFCGEHRYSDRHGCSYDYKAATRDAIARDNPVVRAAKIVRF

SEQ ID NO: 259 - protein, 164 aa, Oryza sativa
  misc_feature (1)..(164): Public GI ID no. 125606142
  misc_feature (1)..(164): Oryza sativa Japonica Group
  misc_feature (105)..(144): Pfam Name: zf-AN1 Pfam Description: AN1-like Zinc finger
  misc_feature (21)..(42): Pfam Name: zf-A20 Pfam Description: A20-like zinc finger
  misc_feature (1)..(164): Bit score of 265.2 for HMM based on sequences of Figure 2
  misc_feature (1)..(164): Functional Homolog Of SEQ ID NO. 237
MAQRDKKDQEPTELRAPEITLCANSCGFPGNPATQNLCQNCFLAATAFTSSPSSLSSPVLDKQPPRPAAPLVEPQAPLPPPVEEMASALATAPAPVAKTSAVNRCSRCRKRVGLTGFRCRCGHLFCGEHRYSDRHGCSYDYKSAARDAIARDNPVVRAAKIVRF

SEQ ID NO: 260 - DNA, 476 bp, Brassica napus
  misc_feature (1)..(476): Ceres Clone ID no. 1040399
  misc_feature (1)..(476): Encodes the peptide sequence at SEQ ID NO. 261
  misc_feature (199)..(199): y is t/u or c
  misc_feature (471)..(471): n is a, c, t, g, unknown, or other
acattccattcatttcctctctctctctctctctctcctctgattctctctatacgacccgtgagctcgccggaggagggtgaaaccaataaagatggcgcagaggacggagaaggaagagacggagttcaaggtcctcgaatccctgacgacccccgccaccgccacgaccacgctctgctcaaataactgcggcgtyacagcgaatccagccaccaacaacatgtgtcagaaatgtttcaacgcttccatcgccgccgccggcgtagactccggttcgacgttgaagagagcgtcgagatccgtcaatcttaggcccacgccagccaaagtcgtgatccgtcccagggagatcgatccggttaagagagatcagcagacggtaaaccggtgttccggttgtcggaagaaggtcgggctgaccgggttcagatgccgatgcggtaaccttttctgctccgagcaccgttnctccg

SEQ ID NO: 261 - protein, 127 aa, Brassica napus
  misc_feature (1)..(127): Ceres Clone ID no. 1040399
  misc_feature (28)..(50): Pfam Name: zf-A20 Pfam Description: A20-like zinc finger
  misc_feature (100)..(126): Pfam Name: zf-AN1 Pfam Description: AN1-like Zinc finger
  misc_feature (1)..(127): Bit score of 128.9 for HMM based on sequences of Figure 2
  misc_feature (1)..(127): Functional Homolog Of SEQ ID NO. 237
  misc_feature (35)..(35): Xaa is any aa, unknown or other
  misc_feature (126)..(126): Xaa is any aa, unknown or other
MAQRTEKEETEFKVLESLTTPATATTTLCSNNCGXTANPATNNMCQKCFNASIAAAGVDSGSTLKRASRSVNLRPTPAKVVIRPREIDPVKRDQQTVNRCSGCRKKVGLTGFRCRCGNLFCSEHRXS

SEQ ID NO: 262 - DNA, 437 bp, Brassica napus
  misc_feature (1)..(437): Ceres Clone ID no. 1093691
  misc_feature (1)..(437): Encodes the peptide sequence at SEQ ID NO. 263
atatttcccattcatttcctctctcttctctctcaacaccattcgcaagctcgccggagaaaatcaacaacgcagatggcgcagagaacagagaaggaagagacggagttcaaggtcctcgaaaccttgacgacgacaacaaccccgacgctctgctccaacaactgcggcgtcacagcgagtccatcaaccaacaacatgtgccagaaatgtttcaacgccggtatagatccaactccgatcgcaaaaagatcagccagatccgtcagtctccggtcaacgccagccaaagctgcgatccgtcccagggagaccgatccggtcaagagagaccaccatcaacagaccgtaaaccgatgctccggttgtcggaagaaagtcgggttgaccggattcagatgccgatgcggcgatcttttctgcgcggagcacgctac

SEQ ID NO: 263 - protein, 120 aa, Brassica napus
  misc_feature (1)..(120): Ceres Clone ID no. 1093691
  misc_feature (24)..(48): Pfam Name: zf-A20 Pfam Description: A20-like zinc finger
  misc_feature (95)..(119): Pfam Name: zf-AN1 Pfam Description: AN1-like Zinc finger
  misc_feature (1)..(120): Bit score of 112.4 for HMM based on sequences of Figure 2
  misc_feature (1)..(120): Functional Homolog Of SEQ ID NO. 237
MAQRTEKEETEFKVLETLTTTTTPTLCSNNCGVTASPSTNNMCQKCFNAGIDPTPIAKRSARSVSLRSTPAKAAIRPRETDPVKRDHHQQTVNRCSGCRKKVGLTGFRCRCGDLFCAEHA

SEQ ID NO: 264 - DNA, 444 bp, Brassica napus
  misc_feature (1)..(444): Ceres Clone ID no. 974539
  misc_feature (1)..(444): Encodes the peptide sequence at SEQ ID NO. 265
ctctctctctcctctcctctcctctcctctcctctcctctctcaatacgatttgtaagctcgccggagtaaatcaacaacacagatggcgcagagaactgaaaaggaagagacagagttcaaggccctcgaaaccttgacgacgacaacaaccccgacgctctgctccaacaactgcggcgtcacagcgtgtccatcaaccaacaacatgtgccagaaatgtttcaacgccgccgccgccggtatagatccaaatccgatcgtaaaaagatcagccagatccgtcagtctccggtcaacgccagccaaagccgcgatccgtcccagggagaccgatccggtcaagagagaccatcatcaacagaccgtaaaccgatgctccggttgtcggaagaatgtcgggttgaccggattcagatgccgatgcggcgaccttttctgcgcg

SEQ ID NO: 265 - protein, 120 aa, Brassica napus
  misc_feature (1)..(120): Ceres Clone ID no. 974539
  misc_feature (24)..(48): Pfam Name: zf-A20 Pfam Description: A20-like zinc finger
  misc_feature (98)..(120): Pfam Name: zf-AN1 Pfam Description: AN1-like Zinc finger
  misc_feature (1)..(120): Bit score of 100.9 for HMM based on sequences of Figure 2
  misc_feature (1)..(120): Functional Homolog Of SEQ ID NO. 237
MAQRTEKEETEFKALETLTTTTTPTLCSNNCGVTACPSTNNMCQKCFNAAAAGIDPNPIVKRSARSVSLRSTPAKAAIRPRETDPVKRDHHQQTVNRCSGCRKNVGLTGFRCRCGDLFCA

SEQ ID NO: 266 - DNA, 949 bp, Gossypium hirsutum
  misc_feature (1)..(949): Ceres Clone ID no. 1832340
  misc_feature (1)..(949): Encodes the peptide sequence at SEQ ID NO. 267
aacgccccctaattttctctccaaccaaacactcattctctccttcctctctatcctccccttcaaatttgttgttttccttttcctccttcgaaatcagctcaaggagatatggctcaaagaaccgaaaaagaagagactgaattcaaagtccctgaaaccctgacgctatgcgttaacaactgcggggttacgggtaatccagccaccaacaacaccgctacttccgctaccgacgataaatcctcgagatctacgccgactcgttcacaggacaatcgatccgattccgctccacctacaacagctgcaacaacggcaacagcaacaacgaatagtccgatgaccgcttcaaatcggtctggatacgataccgcggaaaagaagtcggtgaatcgatgttctggttgcagaaaacgcgttgggttgaccgggttccggtgtcgatgcggggagcttttctgttcggaccatcggtactcggatcgacacgattgtagctacgactacaaggcggcgggtcgcgaagccatcgctagagaaaatcccgtggttaaagcagccaagattatcagagtttgagtttttaccaaatggatccaaattaaattaaataaactattcaaaacatttttcgacctgaaaatagcaagttgtggagatctatgctcgatctcaaaaggaaaaaaaaagtaaaaaaagactgtttcagagagggagaaatgagtcggtcgaaatcttgattacaaaaattcctggagatgaacaagatattctctcctctgattcttctggttggatcaaatctatagtattttcagtttactttttattattaatttagaaatgaaagattatcgagatttattagttgcagttgatatgtgttacggttactagaccccttccatgatcgagatcttatatatcgaggctttggtttagattg

SEQ ID NO: 267 - protein, 156 aa, Gossypium hirsutum
  misc_feature (1)..(156): Ceres Clone ID no. 1832340
  misc_feature (20)..(35): Pfam Name: zf-A20 Pfam Description: A20-like zinc finger
  misc_feature (97)..(136): Pfam Name: zf-AN1 Pfam Description: AN1-like Zinc finger
  misc_feature (1)..(156): Bit score of 268.3 for HMM based on sequences of Figure 2
  misc_feature (1)..(156): Functional Homolog Of SEQ ID NO. 237
MAQRTEKEETEFKVPETLTLCVNNCGVTGNPATNNTATSATDDKSSRSTPTRSQDNRSDSAPPTTAATTATATTNSPMTASNRSGYDTAEKKSVNRCSGCRKRVGLTGFRCRCGELFCSDHRYSDRHDCSYDYKAAGREAIARENPVVKAAKIIRV

SEQ ID NO: 268 - DNA, 699 bp, Gossypium hirsutum
  misc_feature (1)..(699): Ceres Clone ID no. 1933211
  misc_feature (1)..(699): Encodes the peptide sequence at SEQ ID NO. 269
gaaaaaaaaaaaaaaaaaaaaaaaaaaaaaaaaaaaaaaaaaaaaaaaaaaaaaaaaaaaaacgccccctaattttctctccaaccaaacactaattctctccttcctctccatcctccccttcaaatttgttgttttccttttcctccttcaaaatcacctcaaggaaatatggctcaaaaaaccaaaaaaaaaaaaactgaattcaaagtacctgaaaccctgactctatgcgttaacaactggggggttacgggaaatccacccaccaacaacatgggccaaaaatgttttagttccaccacggccgccacatcctcctcttcctcttccaccaacaacaccgctacttccgctaccaacaaaaaatcctcaaaatctaccccaactcgttcacaggacaaccgatccaactccgctccgcctacaacagctgcaacaacggcaacagcaacagcaacaacaaatagtccaatgactgcttcaaatcggtctggatacaataccgcgaaaaaaaagtcggtgaatcgatgttctggttgcaaaaaacgcgttgggttgacggggttccggtgtcaatgcggggagcttttctgttcggaccatcggtactcgaatcgacacaattgtagctacaactacaaggcggcgggtcgcgaagccatcgctagggaaaatcccgtggttaaagcacccaaa

SEQ ID NO: 269 - protein, 176 aa, Gossypium hirsutum
  misc_feature (1)..(176): Ceres Clone ID no. 1933211
  misc_feature (21)..(36): Pfam Name: zf-A20 Pfam Description: A20-like zinc finger
  misc_feature (121)..(160): Pfam Name: zf-AN1 Pfam Description: AN1-like Zinc finger
  misc_feature (1)..(176): Bit score of 240.4 for HMM based on sequences of Figure 2
  misc_feature (1)..(176): Functional Homolog Of SEQ ID NO. 237
MAQKTKKKKTEFKVPETLTLCVNNWGVTGNPPTNNMGQKCFSSTTAATSSSSSSTNNTATSATNKKSSKSTPTRSQDNRSNSAPPTTAATTATATATTNSPMTASNRSGYNTAKKKSVNRCSGCKKRVGLTGFRCQCGELFCSDHRYSNRHNCSYNYKAAGREAIARENPVVKAPK

SEQ ID NO: 270 - DNA, 1064 bp, Zea mays
  misc_feature (1)..(1064): Ceres Clone ID no. 997558
  misc_feature (1)..(1064): Encodes the peptide sequence at SEQ ID NO. 271
ctcgcccgctcgctccgcgctccctccccccctcccgcgcggatcacagacaggctcacggtcacggccggcctcccaattcgcaacctcgcctccgcctctcctcctacccctccgaaaaagcaagctccggccgggccgccaccaccaccaccgcgcgcgcgtgcacgcgctcccacacacagacagacagacagacagacagagtgagagacgcacggtggttcggggtctcccttctgccaggcgcacgaggagccatggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctccggcggccgcggccgtgggccaggctacggaagccgcggcgagggcgtccgcgagccggtgctccagctgccggaagcgcgtggggctgacggggttccggtgccgctgcggcgagctcttctgcggcgcgcaccggtactcggaccggcacggctgcagctacgactacaggggcgccgcccgggacgccatcgcccgggagaacccggtggtgcgcgcggccaaggtcgttaggttctgatgacgggaaggaaggaaggacacagcacaaaggctcgcagggcggagaaggggaggaggaaggcgtgcggacaaggtcttcggtgttattattattacgctgttcctttgattttaatctcctttttttttaaaaaaatatttgtcctatgggaatgggattgggagaagaggtggacgaagaatagtggagtaataataatggtggtggtgcagtggcggtggttgagggcccgaaacgatgaacagatgggttggattgggttgggtgtatgtatgtgtcacacgcaactttggacagaactattatactagtact

SEQ ID NO: 271 - protein, 161 aa, Zea mays
  misc_feature (1)..(161): Ceres Clone ID no. 997558
  misc_feature (102)..(140): Pfam Name: zf-AN1 Pfam Description: AN1-like Zinc finger
  misc_feature (20)..(41): Pfam Name: zf-A20 Pfam Description: A20-like zinc finger
  misc_feature (1)..(161): Bit score of 255.8 for HMM based on sequences of Figure 2
  misc_feature (1)..(161): Functional Homolog Of SEQ ID NO. 237
MAQRDKKEEPTELRAPEITLCANNCGFPGNPATQNLCQSCFSASRSPSSPTSSSSSLASAASQPRPAALVVDAAAVEALAAPAAAAVGQATEAAARASASRCSSCRKRVGLTGFRCRCGELFCGAHRYSDRHGCSYDYRGAARDAIARENPVVRAAKVVRF

SEQ ID NO: 272 - DNA, 798 bp, Sorghum bicolor
  misc_feature (1)..(798): Ceres Annot ID no. 6041596
  misc_feature (1)..(798): Encodes the peptide sequence at SEQ ID NO. 273
atggcgcagcgcgacaagaaggaggagcccacggagctccgggcgccggagatcacgctgtgcgccaacaactgcggcttcccggggaacccggccacgcagaacctgtgccagagctgcttctcggcggccacggcgtcgaggtcgtcgtcgccgtcgtcccctacctcctcttcctcagcttcagcggtgtcgcagccgaggccggcggcactcgtagacgcagcagcggtggagctgctggcctctgcggatgccgcagccgtgggccagtctatggaggtcgtcgccgccgctccggcggccacggcggcgaggtcgtctgctgtgaaccggtgctccagctgccggaagcgggtggggctgacggggttccggtgccggtgcggcgagctcttctgcggcgcgcaccggtactcggaccggcacggctgcagctacgactacaagggcgccggcagggacgccatcgcccgggagaacccggtggtggcccaaaacgatgaacaaatgggttgggttgggttgggttgggttgggtgtatgtatctgtcacacgcaactttgtgcaaaaactattatactacgagtacgtttctcgtctctctcgtacagaaaacaccagcacgagcgatgattggtcaatcattcgtcaggcaggctcgtatactagtaatcatctctgccgatcccggaagtattttttacagactttttcagaccgaaagattgagaagcgatcaactcctctttccgcagaagaattatgcccccgtgtgtggcccacctgctccataa

SEQ ID NO: 273 - protein, 265 aa, Sorghum bicolor
  misc_feature (1)..(265): Ceres Annot ID no. 6041596
  misc_feature (113)..(151): Pfam Name: zf-AN1 Pfam Description: AN1-like Zinc finger
  misc_feature (20)..(41): Pfam Name: zf-A20 Pfam Description: A20-like zinc finger
  misc_feature (1)..(265): Bit score of 242.2 for HMM based on sequences of Figure 2
  misc_feature (1)..(265): Functional Homolog Of SEQ ID NO. 237
MAQRDKKEEPTELRAPEITLCANNCGFPGNPATQNLCQSCFSAATASRSSSPSSPTSSSSASAVSQPRPAALVDAAAVELLASADAAAVGQSMEVVAAAPAATAARSSAVNRCSSCRKRVGLTGFRCRCGELFCGAHRYSDRHGCSYDYKGAGRDAIARENPVVAQNDEQMGWVGLGWVGCMYLSHATLCKNYYTTSTFLVSLVQKTPARAMIGQSFVRQARILVIISADPGSIFYRLFQTERLRSDQLLFPQKNYAPVCGPPAP

SEQ ID NO: 274 - protein, 164 aa, Oryza sativa
  misc_feature (1)..(164): Public GI ID no. 125564176
  misc_feature (1)..(164): Oryza sativa Indica Group
  misc_feature (105)..(144): Pfam Name: zf-AN1 Pfam Description: AN1-like Zinc finger
  misc_feature (21)..(42): Pfam Name: zf-A20 Pfam Description: A20-like zinc finger
  misc_feature (1)..(164): Bit score of 263.3 for HMM based on sequences of Figure 2
  misc_feature (1)..(164): Functional Homolog Of SEQ ID NO. 237
MAQGDKKDQEPTELRAPEITLCANSCGFPGNPATQNLCQNCFLAATASTSSPSSLSSPVLDKQPPRPAAPLVEPQAPLPPPVEEMASALATAPAPVAKTSAVNRCSRCRKRVGLTGFRCRCGHLFCGEHRYSDRHGCSYDYKSAARDAIARDNPVVRAAKIVRF

SEQ ID NO: 275 - DNA, 683 bp, Gossypium hirsutum
  misc_feature (1)..(683): Ceres Clone ID no. 1836064
  misc_feature (1)..(683): Encodes the peptide sequence at SEQ ID NO. 276
atacgcgtctctatgaggcccatattccgtcgccattactgaccgacctttctcgaccccttcaaatcccctctctctctctctctccttaattccaacgccaacgccccctaattttctctccaaccaaacactaattctctccttcctctccatcctccccttcaaatttgttgttttccttttcctccttcgaaatcacctcaaggagatatggctcaaagaaccgaaaaagaagagactgaattcaaagtacctgaaaccctgactctatgcgttaacaactgcggggttacggggaatccagccaccaacaacatgtgccagaaatgttttagttccaccacggccgccacatcctcctcttcctcttccaccaacaacaccgctacttccgctaccgacgataaatcctcgagatctacgccgactcgttcacaggacaaccgatccgactccgctccgcctacaacagctgcaacaacggcaacagcaacagcaacgacgaatagtccgatgactgcttcaaatcggtctggatacgataccgcggaaaagaagtcggtgaatcgatgttctggttgcagaaaacgcgttgggttgacggggttccggtgtcgatgcggggagcttttctgttcggaccatcggtactcggatcgacacgattgtagctacgacta

SEQ ID NO: 276 - protein, 156 aa, Gossypium hirsutum
  misc_feature (1)..(156): Ceres Clone ID no. 1836064
  misc_feature (121)..(156): Pfam Name: zf-AN1 Pfam Description: AN1-like Zinc finger
  misc_feature (20)..(41): Pfam Name: zf-A20 Pfam Description: A20-like zinc finger
  misc_feature (1)..(156): Bit score of 199.1 for HMM based on sequences of Figure 2
  misc_feature (1)..(156): Functional Homolog Of SEQ ID NO. 237
MAQRTEKEETEFKVPETLTLCVNNCGVTGNPATNNMCQKCFSSTTAATSSSSSSTNNTATSATDDKSSRSTPTRSQDNRSDSAPPTTAATTATATATTNSPMTASNRSGYDTAEKKSVNRCSGCRKRVGLTGFRCRCGELFCSDHRYSDRHDCSYD

SEQ ID NO: 277 - DNA, 1100 bp, Panicum virgatum
  misc_feature (1)..(1100): Ceres Clone ID no. 1909693
  misc_feature (1)..(1100): Encodes the peptide sequence at SEQ ID NO. 278
cccccccaaacccatttccttcctgcctccacgacccagcccaggcccggcggtgcctctccctctcgtctccggatcggcaagagcccagctgctgccggattcacacgacacctcgtcgtctctctctctctctctctctctctctctctctctctctctctctctctctcggcccatggcgcagcgcgacaagaaggtggaggagccgacggagctgcacgcgccggagctcacgctctgcgccaacagctgcggcttcccgggcaacccggcgaccaagaacctctgccagaactgcttcctggccgcctcggcctccgtgtcgccgccgtcgccctcctcctcctcctcgtcgccctcgccggcggtgttcgacaagccgcggccggcggtcgcccctaccgccgtgtggccgccgttccccgcggccgccgaccggcccccggcgggccccgcggagtccccctccaaggcgccccggacgtcgtcgtcggtcaaccggtgccacagctgccggaagcgggtcgggctgacggggttccggtgccgctgcggcgagctcttctgcggcgcgcaccggtactcggaccgccacgactgcggctacgactacaagggcgttgcccgggacgccatcgcccgggagaaccccgtcgtgcgcgccgccaagatcgtcaggttctgagagctggggagcaccggaggagaccacgcagctcagctccacgccgatcgtcgatccatctcccgcgctccggaatccccctctctgtttttctcttttctttcctttttacaaaagtttaaaaaggtgattagtcgaggtgctatcatcatgctgttcttgagaattccacaaagaagaagaagaagatgatgatgatcaaggaaaaaggaggagcggatcatggcaaatcatgatgaaggaaaaagggaatcgagagcacagtgcgatgataatgttgtagcggtggttgggggtggagataggggtcggtttggtgtgttgtcctactacaaatcacaatcttctattaaatttttcttccatctctctctgtataaactaaattataattggaatctccctattgccc

SEQ ID NO: 278 - protein, 169 aa, Panicum virgatum
  misc_feature (1)..(169): Ceres Clone ID no. 1909693
  misc_feature (110)..(148): Pfam Name: zf-AN1 Pfam Description: AN1-like Zinc finger
  misc_feature (21)..(42): Pfam Name: zf-A20 Pfam Description: A20-like zinc finger
  misc_feature (1)..(169): Bit score of 266.7 for HMM based on sequences of Figure 2
  misc_feature (1)..(169): Functional Homolog Of SEQ ID NO. 237
MAQRDKKVEEPTELHAPELTLCANSCGFPGNPATKNLCQNCFLAASASVSPPSPSSSSSSPSPAVFDKPRPAVAPTAVWPPFPAAADRPPAGPAESPSKAPRTSSSVNRCHSCRKRVGLTGFRCRCGELFCGAHRYSDRHDCGYDYKGVARDAIARENPVVRAAKIVRF

SEQ ID NO: 279 - DNA, 824 bp, Panicum virgatum
  misc_feature (1)..(824): Ceres Clone ID no. 1765346
  misc_feature (1)..(824): Encodes the peptide sequence at SEQ ID NO. 280
gaacggggcggagcgacttcagaagaggtcgacccgcaccccttgcaggttgagaatcccaagctcccacccgcagtccgcagacacgctccgccgcttcgccccaattcccaaccaccaccaccttcacttcacctcgaccgaaccgatggagcagcaagggagcgagaacacgcaggagccgctcccctgcgccaacaactgcggtttcttcggctccccggccacgcgcaacctctgctccaagtgcttccgcgacagcctccgccacgccgaggcccaggcggtggcggcgacagcgacagcgacggccgcgctcgccgcctcttcttctccggccgcggcgtcagcggatcccgacgcggcgacagcggcagcgacggaggaggcggggaaggcgcgagcgaaggggaagaagagcggccggtgcgcggcgtgcgggaggaaggtggggctgatggggttcgagtgccggtgcggcggcgtcttctgcggcgcgcaccgctactcggaccggcacgactgcggctacgactacaggggcgccggccgcgacgccatcgcccgcgccaaccccgtcgtcagggccgacaagcaggtcgacaagctctgaccgagcagcgccggcgcgtgctctgctctcaggcagcaaaccatcactggcctggcctggctgctcgatcgaagattcgaagtatgcagtatgcttgattgaagtctagtcgattgcaattcgcgtcaacatctctgtacctcttcgctagttcatgatgtatatttgctatacctacctgctgctagtgcagttgcttgttaacagacag

SEQ ID NO: 280 - protein, 154 aa, Panicum virgatum
  misc_feature (1)..(154): Ceres Clone ID no. 1765346
  misc_feature (94)..(132): Pfam Name: zf-AN1 Pfam Description: AN1-like Zinc finger
  misc_feature (12)..(36): Pfam Name: zf-A20 Pfam Description: A20-like zinc finger
  misc_feature (1)..(154): Bit score of 151.0 for HMM based on sequences of Figure 2
  misc_feature (1)..(154): Functional Homolog Of SEQ ID NO. 237
MEQQGSENTQEPLPCANNCGFFGSPATRNLCSKCFRDSLRHAEAQAVAATATATAALAASSSPAAASADPDAATAAATEEAGKARAKGKKSGRCAACGRKVGLMGFECRCGGVFCGAHRYSDRHDCGYDYRGAGRDAIARANPVVRADKQVDKL

SEQ ID NO: 281 - protein, 213 aa, Oryza sativa
  misc_feature (1)..(213): Public GI ID no. 125546008
  misc_feature (1)..(213): Oryza sativa Indica Group
  misc_feature (74)..(98): Pfam Name: zf-A20 Pfam Description: A20-like zinc finger
  misc_feature (154)..(193): Pfam Name: zf-AN1 Pfam Description: AN1-like Zinc finger
  misc_feature (1)..(213): Bit score of 181.1 for HMM based on sequences of Figure 2
  misc_feature (1)..(213): Functional Homolog Of SEQ ID NO. 237
MGGIPFENGSSPIRQGSSSQLLLPLGDQMQWSFISTILCDLEPYWQVQLVFLTMAQESWKKEAEETGVHTPEAPILCVNNCGFFGSRMTENMCSKCYRDTVKAKTVATVVEKKPLASLSSTPLVAEVTDGGSGSVADGKQVMEEDTPKPPSNRCLSCRKKVGLTGFKCRCGGTFCSMHRYADSHKCTFDYKQAGREQIAKQNPLVKADKITKI

SEQ ID NO: 282 - DNA, 915 bp, Panicum virgatum
  misc_feature (1)..(915): Ceres Clone ID no. 1950900
  misc_feature (1)..(915): Encodes the peptide sequence at SEQ ID NO. 283
ctcccgacgctcgacccgaaaaaaaatattctccgcggggggtaagggaaaggtcgcgtggcgtctcgcccacagtccatcggtagcaatggcacaagagagctggaaacaagagtccgaggagactagagtccacgcgcctgaggcccctattctctgcataaacaactgtggtttctttggcagcagcatgacgaacaatatgtgctcgaagtgctatagggacttcatcaagttgatggaagctcctgtggtggagaagaaggtgaccacatcagcatcttcttccacagcaccactggagacaaagcgagatgatgcgcctgccgctgctgccactgaagctgtggctgagaagcaagcagagcaagagcccccaaagccacccagcaaccggtgtctgacttgccgcaagaaggtcgggctgaccggcttcctctgccgttgcgggggcaccttctgctccacgcaccgctacaccgactcccaccagtgcacctttgactataagaaggtggcacgggagcagatagccaagcagaatccagttgtgatggccgagaagataaacaagatctaatgaatggttgtgaagggattcatgcctgggttcctgagtcctcaagttcactataatcgataggttccttcgggtggtggtctgggttagcgtggtagtagggggtctcaattgtgtctatccttctcctttatcatggttccattctctgccggaaagatgcagtggttttgcgtcgtcacttcctctggaagtagtttaagtcgagaagataagattgcacatcaggtattgcttattctggtcctggagggccaagtgttgtatcgacatgtcattggttttgtatcgttgtatgttatcacgtgtgctggaaatcacagcaagtatgaagt

SEQ ID NO: 283 - protein, 163 aa, Panicum virgatum
  misc_feature (1)..(163): Ceres Clone ID no. 1950900
  misc_feature (21)..(45): Pfam Name: zf-A20 Pfam Description: A20-like zinc finger
  misc_feature (104)..(142): Pfam Name: zf-AN1 Pfam Description: AN1-like Zinc finger
  misc_feature (1)..(163): Bit score of 177.2 for HMM based on sequences of Figure 2
  misc_feature (1)..(163): Functional Homolog Of SEQ ID NO. 237
MAQESWKQESEETRVHAPEAPILCINNCGFFGSSMTNNMCSKCYRDFIKLMEAPVVEKKVTTSASSSTAPLETKRDDAPAAAATEAVAEKQAEQEPPKPPSNRCLTCRKKVGLTGFLCRCGGTFCSTHRYTDSHQCTFDYKKVAREQIAKQNPVVMAEKINKI

SEQ ID NO: 284 - protein, 233 aa, Zea mays
  misc_feature (1)..(233): Public GI ID no. 41350259
  misc_feature (174)..(213): Pfam Name: zf-AN1 Pfam Description: AN1-like Zinc finger
  misc_feature (73)..(97): Pfam Name: zf-A20 Pfam Description: A20-like zinc finger
  misc_feature (1)..(233): Bit score of 173.1 for HMM based on sequences of Figure 2
  misc_feature (1)..(233): Functional Homolog Of SEQ ID NO. 237
MVSSPFDLKIWGFGSASRARSGPSSFFPLLYLIGFFASFTQGSSERNRKEGRLIRVKEAMEHKEAGCQAPEGPILCINNCGFFGSAATMNMCSKCHKEMITKQDQAKLAASSIDSIVDGSDAVMEPGGAGSNTVVAVAQVELQKKNVQQPADVAEPNEGVAAISKGGKVGPNRCSACRKRVGLTGFNCRCGNLYCALHRYSDKHDCKFDYRTAARDAIAKANPVVKADKLDKI

SEQ ID NO: 285 - protein, 213 aa, Oryza sativa
  misc_feature (1)..(213): Public GI ID no. 125588210
  misc_feature (1)..(213): Oryza sativa Japonica Group
  misc_feature (74)..(98): Pfam Name: zf-A20 Pfam Description: A20-like zinc finger
  misc_feature (154)..(192): Pfam Name: zf-AN1 Pfam Description: AN1-like Zinc finger
  misc_feature (1)..(213): Bit score of 181.0 for HMM based on sequences of Figure 2
  misc_feature (1)..(213): Functional Homolog Of SEQ ID NO. 237
MGGIPFENGSSPIRQGSSSQLLLPLGDQMQWSFISTILCDLEPYWQVQLVFLTMAQESWKKEAEETGVHTPEAPILCVNNCGFFGSRMTENMCSKCYRDTVKAKTVATVVEKKPLASLSSTPLVTEVTDGGSGSVADGKQVMEEDTPKPPSNRCLSCRKKVGLTGFKCRCGGTFCSMHRYADSHKCTFDYKQVGREQIAKQNPLVKADKITKI

SEQ ID NO: 286 - DNA, 820 bp, Panicum virgatum
  misc_feature (1)..(820): Ceres Clone ID no. 1954395
  misc_feature (1)..(820): Encodes the peptide sequence at SEQ ID NO. 287
gccctcgccctcgccttcgccttcgcctacctctcgacgcccaaccccaaaaagaaaaattctcctcgcggagaaaggtcgcgtgccgtctcgcccacagcccatctgtaacaatggcacaggagagctggaaacaggaatctgaggagactggagtccatgcacctgaggccccaattctgtgcataaacaactgtggtttcttcggcagcagcatgacgaacaatatgtgctcgaagtgctacagggacttcatcaaattgatggaaggccctgtggttgagaagaaggtgatcacggtggcatcttcttctgcggcaccaatggagacagcaaagcaagatgatgtgcctgcagctgctgccactgaagctgtgacggagaagcaagcagagcaggagccgccaaagccgcccagcaaccggtgccttacctgccgcaagaaggttgggctgactggcttcctctgccgctgcgggggcaccttctgctccatgcaccgctacactgactcccaccagtgcaccttcgactacaagaaggtggcacgggagcagattgccaagcaaaatccagttgtgatggcagagaagattaacaagatatgatgcatggtcatgtgaagggatcactaaattcatgcctgggtagtgggttcactccaaatgataggttccttcaggcggtggtctgggtctgggttagagtggtagctggtctcaattgtgtctatcctcctcctttatcatggtttcattctctcgattgtgtaataatgtaaatatattcaaactgtaatttaatcctattgcttcctact

SEQ ID NO: 287 - protein, 164 aa, Panicum virgatum
  misc_feature (1)..(164): Ceres Clone ID no. 1954395
  misc_feature (21)..(45): Pfam Name: zf-A20 Pfam Description: A20-like zinc finger
  misc_feature (105)..(143): Pfam Name: zf-AN1 Pfam Description: AN1-like Zinc finger
  misc_feature (1)..(164): Bit score of 174.0 for HMM based on sequences of Figure 2
  misc_feature (1)..(164): Functional Homolog Of SEQ ID NO. 237
MAQESWKQESEETGVHAPEAPILCINNCGFFGSSMTNNMCSKCYRDFIKLMEGPVVEKKVITVASSSAAPMETAKQDDVPAAAATEAVTEKQAEQEPPKPPSNRCLTCRKKVGLTGFLCRCGGTFCSMHRYTDSHQCTFDYKKVAREQIAKQNPVVMAEKINKI

SEQ ID NO: 288 - protein, 173 aa, Arabidopsis thaliana
  misc_feature (1)..(173): Public GI ID no. 18403408
  misc_feature (15)..(39): Pfam Name: zf-A20 Pfam Description: A20-like zinc finger
  misc_feature (114)..(152): Pfam Name: zf-AN1 Pfam Description: AN1-like Zinc finger
  misc_feature (1)..(173): Bit score of 149.4 for HMM based on sequences of Figure 2
  misc_feature (1)..(173): Functional Homolog Of SEQ ID NO. 237
MDHDKTGCQSPPEGPKLCTNNCGFFGSAATMNMCSKCHKDMLFQQEQGAKFASAVSGTSSSSNIIKETFTAALVDIETKSVEPMTVSVQPSSVQVVAEVVAPEEAAKPKGPSRCTTCNKRVGLTGFKCRCGSLFCGTHRYADVHDCSFNYHAAAQEAIAKANPVVKAEKLDKI

SEQ ID NO: 289 - DNA, 965 bp, Panicum virgatum
  misc_feature (1)..(965): Ceres Clone ID no. 2010121
  misc_feature (1)..(965): Encodes the peptide sequence at SEQ ID NO. 290
cctggcccgacgacgcccccatttcgaggctcctccttgcgattccaatccccgcccgcctcctccgcctccgcgtccgcctcgcgcagggtttggcttatagtagtcatggaacacaaggagacgggctgccagcaaccggagggcccaatactatgcatcaacaactgtggcttctttggcagtgcggccaccatgaacatgtgctccaagtgccacaaggagatgataatgaagcaggagcattcccagctggctgcctcctccattgatagcattgtcaatggcggtgatggtgggaaaggccctatcatagctgcaaccgcagaggtggcggttgctcaagttgaggagaagactattgttgtgcagcctccatttgtagctgaaaccagcgaggctgctgccattatccccaaggccaaggaaggtccgaaccggtgcgcaacctgtaggaagcgggttggtctgacgggattcaactgccgatgcggtaacatgtactgtgcgttgcaccgctactccgacaaacatgactgccagtttgactaccagactgcagctagggatgcgattgccaaggccaatcctgtggtgaaggcggagaagcttgaaaagatctgaagggggcaatggggaacgaaatgggttgcgatctgcaagattcaatcatgcatctttgctgctttatcattgaacatcccattcttgtttgctgccacatccctgagtcgttcaacactatgatgctcacgcatcctggcagctgcaagaagtcatcctcagtcgagtccaaaatggtttgcgtgttggctatgttgtgtaagcttattcagttattcatggtggtttcagtcggtattgtggcatttccatttaggtagctctgtaatgtactactgtctcatgcgtgttacattccaatcagtaatagtaatcagcaatggtctgcaatatttcctctt

SEQ ID NO: 290 - protein, 171 aa, Panicum virgatum
  misc_feature (1)..(171): Ceres Clone ID no. 2010121
  misc_feature (112)..(151): Pfam Name: zf-AN1 Pfam Description: AN1-like Zinc finger
  misc_feature (14)..(38): Pfam Name: zf-A20 Pfam Description: A20-like zinc finger
  misc_feature (1)..(171): Bit score of 169.4 for HMM based on sequences of Figure 2
  misc_feature (1)..(171): Functional Homolog Of SEQ ID NO. 237
MEHKETGCQQPEGPILCINNCGFFGSAATMNMCSKCHKEMIMKQEHSQLAASSIDSIVNGGDGGKGPIIAATAEVAVAQVEEKTIVVQPPFVAETSEAAAIIPKAKEGPNRCATCRKRVGLTGFNCRCGNMYCALHRYSDKHDCQFDYQTAARDAIAKANPVVKAEKLEKI

SEQ ID NO: 291 - DNA, 519 bp, Sorghum bicolor
  misc_feature (1)..(519): Ceres Annot ID no. 6011486
  misc_feature (1)..(519): Encodes the peptide sequence at SEQ ID NO. 292
atggcacaagagagctggaaacaagagtctgaggaaactggagtccatgcccctgaggccccgattctgtgcataaacaattgtggtttcttcggcagcagcatgacaaacaatatgtgctcgaagtgctatagggacttcatcaagttgatggaaacccctgtggtggagaagaaggttatagcaggggcatcatcctctgcagtgctgccactagaggcagcaaagcgagacgcattgcccaccgctgctgctgctgctgctgctgaagcagccgcagctgtagacgacaagcaagcagcacaggaggagcccccaaagccgccgagcaaccggtgcctgacgtgccgcaagaaggtggggctgactgggttccagtgccgctgcggtggaaccttctgctccatgcaccgctacacggactcccaccagtgcaccttcgactacaagacagcggccagggagcagatcgccaagcagaaccctgtcgtgatggccgagaagatcaacaagatctga

SEQ ID NO: 292 - protein, 172 aa, Sorghum bicolor
  misc_feature (1)..(172): Ceres Annot ID no. 6011486
  misc_feature (21)..(45): Pfam Name: zf-A20 Pfam Description: A20-like zinc finger
  misc_feature (113)..(152): Pfam Name: zf-AN1 Pfam Description: AN1-like Zinc finger
  misc_feature (1)..(172): Bit score of 178.4 for HMM based on sequences of Figure 2
  misc_feature (1)..(172): Functional Homolog Of SEQ ID NO. 237
MAQESWKQESEETGVHAPEAPILCINNCGFFGSSMTNNMCSKCYRDFIKLMETPVVEKKVIAGASSSAVLPLEAAKRDALPTAAAAAAAEAAAAVDDKQAAQEEPPKPPSNRCLTCRKKVGLTGFQCRCGGTFCSMHRYTDSHQCTFDYKTAAREQIAKQNPVVMAEKINKI

SEQ ID NO: 293 - protein, 173 aa, Arabidopsis thaliana
  misc_feature (1)..(173): Public GI ID no. 25082726
  misc_feature (15)..(39): Pfam Name: zf-A20 Pfam Description: A20-like zinc finger
  misc_feature (114)..(152): Pfam Name: zf-AN1 Pfam Description: AN1-like Zinc finger
  misc_feature (1)..(173): Bit score of 149.6 for HMM based on sequences of Figure 2
  misc_feature (1)..(173): Functional Homolog Of SEQ ID NO. 237
MDHDKTGCQSPPEGPKLCTNNCGFFGSAATMNMCSKCHKDMLFQQEQGTKFASAVSGTSSSSNIIKETFTAALVDIETKSVEPMTVSVQPSSVQVVAEVVAPEEAAKPKGPSRCTTCNKRVGLTGFKCRCGSLFCGTHRYADVHDCSFNYHAAAQEAIAKANPVVKAEKLDKI

SEQ ID NO: 294 - protein, 173 aa, Camellia sinensis
  misc_feature (1)..(173): Public GI ID no. 113196593
  misc_feature (114)..(153): Pfam Name: zf-AN1 Pfam Description: AN1-like Zinc finger
  misc_feature (15)..(39): Pfam Name: zf-A20 Pfam Description: A20-like zinc finger
  misc_feature (1)..(173): Bit score of 161.8 for HMM based on sequences of Figure 2
  misc_feature (1)..(173): Functional Homolog Of SEQ ID NO. 237
MEQNETGCQVPPDAPMLCVNNCGFFGSAATMNPCSKCHKDLMLKQQQTELAASSIGSIANGGSGSPGKEPDSAITTVHVDAGSSDSMIVSMQASHESLLNENNVIVKEVPPNRCSACRKRVGLTGFNCRCGNLFCAVHRYSDKHDCPFDYRSAAQDAIAKANPVVKAEKLDKL

SEQ ID NO: 295 - DNA, 972 bp, Gossypium hirsutum
  misc_feature (1)..(972): Ceres Clone ID no. 1843021
  misc_feature (1)..(972): Encodes the peptide sequence at SEQ ID NO. 296
ttttctgctatcagtttcattacataatatatctcttcgattaaagaatcgctgggttcgattttgtcagacaagatcggccaaattaagatttcaggagattagagaagatggaccctcatgatgagacgggccgccaagcttcagaaggccccatcctgtgtgttaataactgtggtttctttggaagtgcggcgaccatgaatatgtgctccaaatgtcacaaggcaatgatcctgaagcaggaacaggcacaactcgtagcatcatccatcgatagcattgttaatggcagcactagcgggaatggtaaggaaccatctgttgctgctgctttggctgtgcaatgtggaaattttgggtcaaaaattgaatcatccatcgatccatcccatatgaccttcggtgggatgaaaacaaaagagggtcccaacaggtgtaatgcatgccacaagcgtgttggtttgacaggatttagctgcaggtgtggaaacatcttctgtgcagcacataggtactctgacaaacacaactgtcctttcgattataggacagctgcccgcgatgctattgctaaagccaacccggtagtgagggctgagaaacttgataaaatctaaaaagagtcgaggatgaagatgaaggtgaaggtgaagaattgtgtaatgaagtatggggtttatggtcctacccattgtgtcgtcagctcatcatagtgaaggtttatttaaagttgggtgctttgtctcattaggtgtcccctttgatttgatataaaaaacaagttggaaagtggatagggaggacaccattgcagtgtaaggaaagtctatattccttgtcaatttgttggcgatacatttaagttcgcccctgtttgtaagtctttgtttgtgctggtttgatggaacaatcgatatgatcgccttgtaatgcttcttttcatatgcacttctttcttctagtagcacc

SEQ ID NO: 296 - protein, 169 aa, Gossypium hirsutum
  misc_feature (1)..(169): Ceres Clone ID no. 1843021
  misc_feature (15)..(39): Pfam Name: zf-A20 Pfam Description: A20-like zinc finger
  misc_feature (110)..(149): Pfam Name: zf-AN1 Pfam Description: AN1-like Zinc finger
  misc_feature (1)..(169): Bit score of 168.5 for HMM based on sequences of Figure 2
  misc_feature (1)..(169): Functional Homolog Of SEQ ID NO. 237
MDPHDETGRQASEGPILCVNNCGFFGSAATMNMCSKCHKAMILKQEQAQLVASSIDSIVNGSTSGNGKEPSVAAALAVQCGNFGSKIESSIDPSHMTFGGMKTKEGPNRCNACHKRVGLTGFSCRCGNIFCAAHRYSDKHNCPFDYRTAARDAIAKANPVVRAEKLDKI

SEQ ID NO: 297 - DNA, 1006 bp, Gossypium hirsutum
  misc_feature (1)..(1006): Ceres Clone ID no. 1931194
  misc_feature (1)..(1006): Encodes the peptide sequence at SEQ ID NO. 298
atttttaaaaaaatcctcctaaaaaagaaaaagaaaaaatcacccgcaatttctctttctcctatcagtttcgttacataatatatctcttcgattaaagaatcgctgggttcgattttgtcagacaagatcggccaaattaagatatcagagaagatggaccctcttgatgagacaggccgccaagcttcagaaggccccatcctgtgtgttaataactgtggtttctttggaagtgcggctaccatgaatatgtgctccaaatgtcacaaggcaatgatcctgaagcaggaacaggcacaactcgtagcatcatccatcgatagcattgttaatggcagcactagcgggaatggtaaggaaccatctgttgctgctgctttggctgtgcaatgtggaaattttgggtcaaaaattgaatcatccatcgatccatcccatatgaccttcggtgggatgaaaacaaaagagggtcccaacaggtgtaatgcatgccacaagcgtgttggtttgacaggatttagctgcaggtgtggaaacatcttctgtgcagcgcataggtactctgacaaacacaactgtcctttcgattataggacagccgcccgcgatgctattgctaaagccaatccggtagtgagggctgagaaacttgataaaatctaaaaagagtagaggatgaaggtgaaggtgaagaattgtgtaatgaagtatggggtttatggtcctacccattgtgtcgtcagctcatcatagtgaaggtttatttaaagttgggtgctttgtctcattaggtgtcccctttgatttgatataaaaaacaagttggaaagtggataatagggaggacaccattgcagtgtaaggaaagtctatattccttgtcaatttgttggcgatacatttaagttcgcccctgtttgtaagtctttgtttgtgctggtttgatggaacaatcgatatgatcgccttgtaatgcttcttttcatatgcacttctttcttcc

SEQ ID NO: 298 - protein, 169 aa, Gossypium hirsutum
  misc_feature (1)..(169): Ceres Clone ID no. 1931194
  misc_feature (15)..(39): Pfam Name: zf-A20 Pfam Description: A20-like zinc finger
  misc_feature (110)..(149): Pfam Name: zf-AN1 Pfam Description: AN1-like Zinc finger
  misc_feature (1)..(169): Bit score of 167.3 for HMM based on sequences of Figure 2
  misc_feature (1)..(169): Functional Homolog Of SEQ ID NO. 237
MDPLDETGRQASEGPILCVNNCGFFGSAATMNMCSKCHKAMILKQEQAQLVASSIDSIVNGSTSGNGKEPSVAAALAVQCGNFGSKIESSIDPSHMTFGGMKTKEGPNRCNACHKRVGLTGFSCRCGNIFCAAHRYSDKHNCPFDYRTAARDAIAKANPVVRAEKLDKI

SEQ ID NO: 299 - DNA, 919 bp, Gossypium hirsutum
  misc_feature (1)..(919): Ceres Clone ID no. 1850070
  misc_feature (1)..(919): Encodes the peptide sequence at SEQ ID NO. 300
aaaataaaataaaatccaaaaagaaaaatcatacgatcaaagatcgtctttctcgtctggatttctccgattatcatacataaaactcttcgattaagtgatcactgggttcgattttgttagacaagatcggccgattaggatttcaggggattagagaagatggagtctcacgatgagacagggtgccaagccccagaaggccccattctttgtatcaacaactgtggcttcttcggcagtgcagctaccatgaatatgtgctccaagtgtcacaaagcgatgatcctgaagcaggaacaggcgcaacttgcagcatcatcaatcggaagcatcgtgaatggcagctcaactgggaacggtaaggaaccagccgtggctactgctttggatgtacaatctggaaacgccgacaccaaaatggtctcaacagagctacccattgacccatccggaacgacttcatgtgggatgaaaatgaaagagggtcctaacaggtgtaccaaatgctgtaaacgtgttggtttgacaggatttaactgcaggtgtggaaacctcttctgtgcagctcatcgttactccgacaaacatgactgccctttcgattaccgagctgctgctcgcaatgctattgctaaagccaacccagttgttcgggcagagaagctcgataaaatctgagaacaacccgggtcaagatgaagatatgtggatggtttatgtaagttggttacttgtctcatcaagtgtccccttgattgatattaaatgttgggagtccatcatagggagggacatgatttgcattgtaagtctatattttcccgtttgtaagtgtttttatttgtgcttgtttgatggacattgatatgatcaacttgtaatgcttcttctttgtggtatgcattttttttctttt

SEQ ID NO: 300 - protein, 172 aa, Gossypium hirsutum
  misc_feature (1)..(172): Ceres Clone ID no. 1850070
  misc_feature (15)..(39): Pfam Name: zf-A20 Pfam Description: A20-like zinc finger
  misc_feature (113)..(151): Pfam Name: zf-AN1 Pfam Description: AN1-like Zinc finger
  misc_feature (1)..(172): Bit score of 173.6 for HMM based on sequences of Figure 2
  misc_feature (1)..(172): Functional Homolog Of SEQ ID NO. 237
MESHDETGCQAPEGPILCINNCGFFGSAATMNMCSKCHKAMILKQEQAQLAASSIGSIVNGSSTGNGKEPAVATALDVQSGNADTKMVSTELPIDPSGTTSCGMKMKEGPNRCTKCCKRVGLTGFNCRCGNLFCAAHRYSDKHDCPFDYRAAARNAIAKANPVVRAEKLDKI

SEQ ID NO: 301 - DNA, 543 bp, Sorghum bicolor
  misc_feature (1)..(543): Ceres Annot ID no. 6034955
  misc_feature (1)..(543): Encodes the peptide sequence at SEQ ID NO. 302
atggcgcagaagcgaaagagcatcgacgtcgtcgaggactgcggcggccacgcgcccgccgccaggcggtgtgcgaacgggtgcgggtacttcggcaacgccgcgaccggcggcatgtgctccaagtgctaccgcaagcacgccgccgccggcgccacggcgacgtctacctctaccaccaccgctgacaagaagacgacgacggcgcaggctgtttccgagacgccggcgccggcggagaagaaggccaagatcgcgtgcgccgtcgcgtcgtcgtcccctggcggcggcgtcgacaatgcaggcgcggcccgggctccgtccacggagccgcagccggtgaagcagactgcgaaccggtgctcggcgtgccgcaagaaagtgggcctgctggggttccggtgctgctgcggggaaaccttctgcggcgcgcaccggtacgcggagaagcacgcctgcggctacgactacaaaagcgccggccgcgagcggatcgccaagaacaacccggtcgtcgtcgccgacaagatcgccaagatttga

SEQ ID NO: 302 - protein, 180 aa, Sorghum bicolor
  misc_feature (1)..(180): Ceres Annot ID no. 6034955
  misc_feature (121)..(160): Pfam Name: zf-AN1 Pfam Description: AN1-like Zinc finger
  misc_feature (22)..(45): Pfam Name: zf-A20 Pfam Description: A20-like zinc finger
  misc_feature (1)..(180): Bit score of 153.4 for HMM based on sequences of Figure 2
  misc_feature (1)..(180): Functional Homolog Of SEQ ID NO. 237
MAQKRKSIDVVEDCGGHAPAARRCANGCGYFGNAATGGMCSKCYRKHAAAGATATSTSTTTADKKTTTAQAVSETPAPAEKKAKIACAVASSSPGGGVDNAGAARAPSTEPQPVKQTANRCSACRKKVGLLGFRCCCGETFCGAHRYAEKHACGYDYKSAGRERIAKNNPVVVADKIAKI

SEQ ID NO: 303 - DNA, 453 bp, Sorghum bicolor
  misc_feature (1)..(453): Ceres Annot ID no. 6119444
  misc_feature (1)..(453): Encodes the peptide sequence at SEQ ID NO. 304
atggcggaggagcagcagcagcagcagcagcagaggtggcaggacggccaccgcctgtgcgccaacaactgcggcttcttcggcagccccgcgacgctggacctctgctccaagtgctaccgcgacctgtacccgcaggagcagcagcagccagcaccagcgggccccttcgttcctgccgcgtcggccttccatccttcctcctcgtcggtctctcccgagcccgagcctccggcggcctctgctgcaggcgccaaggccggcaggtgcgccagctgccggaagcgcgtgggcctgacggggttcgcgtgccgctgcggcgccaccttctgcggcgtgcaccggtacccggagcggcacgcgtgcgccttcgacttccgcgccgccggccgcgacgccatcgcgcgcgccaaccccgtcgtcaagggcgacaagctcaaggacaagatctga

SEQ ID NO: 304 - protein, 150 aa, Sorghum bicolor
  misc_feature (1)..(150): Ceres Annot ID no. 6119444
  misc_feature (90)..(128): Pfam Name: zf-AN1 Pfam Description: AN1-like Zinc finger
  misc_feature (18)..(41): Pfam Name: zf-A20 Pfam Description: A20-like zinc finger
  misc_feature (1)..(150): Bit score of 151.6 for HMM based on sequences of Figure 2
  misc_feature (1)..(150): Functional Homolog Of SEQ ID NO. 237
MAEEQQQQQQQRWQDGHRLCANNCGFFGSPATLDLCSKCYRDLYPQEQQQPAPAGPFVPAASAFHPSSSSVSPEPEPPAASAAGAKAGRCASCRKRVGLTGFACRCGATFCGVHRYPERHACAFDFRAAGRDAIARANPVVKGDKLKDKI

SEQ ID NO: 305 - DNA, 600 bp, Sorghum bicolor
  misc_feature (1)..(600): Ceres Annot ID no. 6063956
  misc_feature (1)..(600): Encodes the peptide sequence at SEQ ID NO. 306
atggcggagaggcaggaggtcatctccggcgtcggtgcggcagcggcaccgatgtgcgccaacggctgcgggttcttcgggagcgcggcgaccaacaacttctgctcaacgtgctacaagcaggatcacctgatgatcaccaagaccgccggcgccggcgccgctcccctggaagcgtccggccgccgcggcctcatcgagtgcgccaacgcgtgcggttacttcgggtacccagcgaccaacaacctgtgcaccctctgctacagggacttcctcgaaagcgttcactcctcccctgccgcggcggacaaggtcgtcgtcctcgctgccgagcagccggcggcggcccagatctctgctgcaacttctagtgctacacgggcggtggaggcggcggcggcggcggcgtcgagcaggtgcgcgtcgtgccgcaagaaggtggggctgctggggtttccctgccgctgtggcggcacgttctgcgcgctgcaccggtacgcggagaagcacgcctgcggcttcgacttcaaggcggcgggccgggagaagatcgccaagaacaacccgctcgtcgtggccgccaagatcaacaagatctga

SEQ ID NO: 306 - protein, 199 aa, Sorghum bicolor
  misc_feature (1)..(199): Ceres Annot ID no. 6063956
  misc_feature (140)..(178): Pfam Name: zf-AN1 Pfam Description: AN1-like Zinc finger
  misc_feature (16)..(40): Pfam Name: zf-A20 Pfam Description: A20-like zinc finger
  misc_feature (1)..(199): Bit score of 135.4 for HMM based on sequences of Figure 2
  misc_feature (1)..(199): Functional Homolog Of SEQ ID NO. 237
MAERQEVISGVGAAAAPMCANGCGFFGSAATNNFCSTCYKQDHLMITKTAGAGAAPLEASGRRGLIECANACGYFGYPATNNLCTLCYRDFLESVHSSPAAADKVVVLAAEQPAAAQISAATSSATRAVEAAAAAASSRCASCRKKVGLLGFPCRCGGTFCALHRYAEKHACGFDFKAAGREKIAKNNPLVVAAKINKI

SEQ ID NO: 307 - DNA, 570 bp, Sorghum bicolor
  misc_feature (1)..(570): Ceres Annot ID no. 6015461
  misc_feature (1)..(570): Encodes the peptide sequence at SEQ ID NO. 308
atgtcgcggcagcagataggtggcggtggcagcgccacgccgatgtgcgccgcgggctgcggtttctttgggagcccggcgaccctcggcatgtgctccgtctgctacaagaagcactgctgcaccattacggacggtccaggcgcctcctacgccgcaacggcgatcgatcccgtcgtcacccgatccaccgctaccgcggtgacccccgggcccggcgccgccgcggctaagccaacggtggtggccgcgcgcacgcccgccgcgagcgtctgtttgttggctcctgctgctaaaggcgccgtagcggaggccgccgccgtgtcgccgccccacgctcccgaggcggcggcgaagaagaagaaggcgccgccaccgggccggtgcgcggcgtgctgcaagaaggtggggctcacggggttcgtgtgccgatgcgggaacacgttctgcgggagccaccggtacgcggaggagcacggctgcagcttcgacttcaagggcgccagccgtgacgccatcgcccgcgccaacccggtcatcaaggcggagaagctgaccggcaagatctga

SEQ ID NO: 308 - protein, 189 aa, Sorghum bicolor
  misc_feature (1)..(189): Ceres Annot ID no. 6015461
  misc_feature (14)..(37): Pfam Name: zf-A20 Pfam Description: A20-like zinc finger
  misc_feature (129)..(168): Pfam Name: zf-AN1 Pfam Description: AN1-like Zinc finger
  misc_feature (1)..(189): Bit score of 112.6 for HMM based on sequences of Figure 2
  misc_feature (1)..(189): Functional Homolog Of SEQ ID NO. 237
MSRQQIGGGGSATPMCAAGCGFFGSPATLGMCSVCYKKHCCTITDGPGASYAATAIDPVVTRSTATAVTPGPGAAAAKPTVVAARTPAASVCLLAPAAKGAVAEAAAVSPPHAPEAAAKKKKAPPPGRCAACCKKVGLTGFVCRCGNTFCGSHRYAEEHGCSFDFKGASRDAIARANPVIKAEKLTGKI

SEQ ID NO: 309 - DNA, 1324 bp, Triticum aestivum
  misc_feature (1)..(1324): Ceres Clone ID no. 696244
  misc_feature (1)..(1324): Encodes the peptide sequence at SEQ ID NO. 310
atgcgcaacgccggctgttgaatattcttgctctatataaagggtccgttgctctgcatatggtgtacaagaacagagagggacagacacatttaacccaaggaccacgtacttccctagcttcttcccacgttgagctgagcgatggaccgacaagttcccgctacagatccttggtggtaccccggcgaggccgcagcatccaccggcgacgacgacttcctcgacattgaaggtctactcgggttggcgtgggaaggaggcacggctcttcccggcgtcggctctccgccaccggcgctggggccaccgtgcgcgtcgcctccagagccaacaccttccgaagacgtgatggcagcgtggctctacccgatcgtcagtggcgaggacaatgccggggacggccccatggtgaagggcaaaccgtcggccaaggcgtcggggagtttggggatgacggagagcgaggggaatcttccggctacggacggcatgtaccatgtcaaggagagctgtgatctcaacaaggacgaggccgagatcctgaagccatcctcctccacaccttcgcctccttccccaaccacaccaccaccaccaaccgctcaaataccagaaccgcaacctccacagtcgccaccacaaccaccggcagctcaattcttgtccaggccctgtgaagttgttcacatagagacttccaaaaagaggaaacatgctgatgcggtgtcaatggccatggcggctgcgccattgtcgcctgtgctgtttgttaaccgttgcaacgtgtgccgcaagagagttggtttgaccgggtttcgttgccggtgcgagaagctcttttgtccgcgccaccggcattcagaaagccacgactgctcatttgattataaaactgcgggccgggaggagattgcccgggcaaaccctcttatcagggctgccaagatcattaggatatgaggttcatctaagaattatatgaaagacttaaatcttggagatgctgcaagtgtatcatgctgtcattccaaggatgatccgaaagcatgaccactgccaacttgtgaagacattccccaaacaactaagctcttagtagcatacaagcctacattgagcaagagttggttgttgtgggagaatgcttcactcttgttcttcgtctggctatggttcactctatagcatctgaagctaccatgaacacagatgatagaacctatagtgtccagttgtaattctgttggatccaaagatttgttatattgtaatctttctttactattgttcaaattctacttaatgcaattgtgtgttactc

SEQ ID NO: 310 - protein, 156 aa, Triticum aestivum
  misc_feature (1)..(156): Ceres Clone ID no. 696244
  misc_feature (2)..(12): Pfam Name: zf-A20 Pfam Description: A20-like zinc finger
  misc_feature (97)..(136): Pfam Name: zf-AN1 Pfam Description: AN1-like Zinc finger
  misc_feature (1)..(156): Bit score of 119.2 for HMM based on sequences of Figure 2
  misc_feature (1)..(156): Functional Homolog Of SEQ ID NO. 237
MYHVKESCDLNKDEAEILKPSSSTPSPPSPTTPPPPTAQIPEPQPPQSPPQPPAAQFLSRPCEVVHIETSKKRKHADAVSMAMAAAPLSPVLFVNRCNVCRKRVGLTGFRCRCEKLFCPRHRHSESHDCSFDYKTAGREEIARANPLIRAAKIIRI

SEQ ID NO: 311 - DNA, 444 bp, Populus trichocarpa
  misc_feature (1)..(444): Ceres Annot ID no. 1468973
  misc_feature (1)..(444): Encodes the peptide sequence at SEQ ID NO. 312
atggactcgataaacagctcaactcttcctttgtgtgccaagggttgcgggttctttggttctccagagaacgagaatttttgttcaaagtgttataaagagtatctcaaagaagggttaattgctgagccttccaagaaactctctgaacctatcgtagtcaccccatcttttgatgataatagcccagatgttgttaccgacgaaacaacttcaacaactactgctgttgcatccacttcaaaagtgaagaatagatgtgaatgctgcaacaagaaagttggtttgatggggttcgagtgccgctgtgggaacaccttctgtggggttcatcgatatcctaaggagcactcttgtacttttgatttcaagactcttgatcaacaaaatttggccaagcaaaatccacttgttgcaggtgataaacttggttccagaatttga

SEQ ID NO: 312 - protein, 147 aa, Populus trichocarpa
  misc_feature (1)..(147): Ceres Annot ID no. 1468973
  misc_feature (10)..(33): Pfam Name: zf-A20 Pfam Description: A20-like zinc finger
  misc_feature (87)..(125): Pfam Name: zf-AN1 Pfam Description: AN1-like Zinc finger
  misc_feature (1)..(147): Bit score of 98.9 for HMM based on sequences of Figure 2
  misc_feature (1)..(147): Functional Homolog Of SEQ ID NO. 237
MDSINSSTLPLCAKGCGFFGSPENENFCSKCYKEYLKEGLIAEPSKKLSEPIVVTPSFDDNSPDVVTDETTSTTTAVASTSKVKNRCECCNKKVGLMGFECRCGNTFCGVHRYPKEHSCTFDFKTLDQQNLAKQNPLVAGDKLGSRI

SEQ ID NO: 313 - DNA, 642 bp, Panicum virgatum
  misc_feature (1)..(642): Ceres Clone ID no. 2019529
  misc_feature (1)..(642): Encodes the peptide sequence at SEQ ID NO. 314
gccttcgcctacctctcgacgcccaaccccaaaaagaaaaattctcctcgcggagaaaggtcgcgtgccgtctcgcccacagttccgggcactgattgcttcgcctgtatgctgctggttgcctgccttgtgctgctactacatatgcaatctgtggagcaaccaaaaagaccttggcttcatgctatgattgtgtaaagcaattgactaaccaagcccatctgtaacaatggcacaggagagctggaaacaggaatctgaggagactggagtccatgcacctgaggccccaattctgtgcataaacaactgtggtttcttcggcagcagcatgacgaacaatatgtgctcgaagtgctacagggacttcatcaaattgatggaaggccctgtggttgagaagaaggtgatcacggtggcatcttcttctgcggcaccaatggagacagcaaagcaagatgatgtgcctgcagctgctgccactgaagctgtgacggagaagcaagcagagcaggagccgccaaagccgcccagcaaccggtgccttacctgccgcaagaaggttgggctgactggcttcctctgccgctgcgggggcaccttctgctccatgcaccgctacactgactcccaccagtgcac

SEQ ID NO: 314 - protein, 137 aa, Panicum virgatum
  misc_feature (1)..(137): Ceres Clone ID no. 2019529
  misc_feature (21)..(45): Pfam Name: zf-A20 Pfam Description: A20-like zinc finger
  misc_feature (105)..(137): Pfam Name: zf-AN1 Pfam Description: AN1-like Zinc finger
  misc_feature (1)..(137): Bit score of 83.6 for HMM based on sequences of Figure 2
  misc_feature (1)..(137): Functional Homolog Of SEQ ID NO. 237
MAQESWKQESEETGVHAPEAPILCINNCGFFGSSMTNNMCSKCYRDFIKLMEGPVVEKKVITVASSSAAPMETAKQDDVPAAAATEAVTEKQAEQEPPKPPSNRCLTCRKKVGLTGFLCRCGGTFCSMHRYTDSHQC

SEQ ID NO: 315 - DNA, 626 bp, Zea mays
  misc_feature (1)..(626): Ceres Clone ID no. 1492169
  misc_feature (1)..(626): Encodes the peptide sequence at SEQ ID NO. 316
gctcgctccctccctccctccctcccgcgcggatcacagaagggctcacggtcacggccggcctcccaattcgcaacctcgcctccgcctctcctcctaccccctccgaaaagcaagctccggccgggccgccaccaccaccaccgcgcgcgcgtgcacgcgctcccacacacagacagacagacagacagacagagtgagagacgcacggtggttcggggtctcccttctgccaggcgcacgaggagccatggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctccggcggccgcggccgcgggccagggccaggctacggaagccgcggcgagggcgtccgcgagccggtgctccagctgccggaagcgcgtggggctgacggggttccggtgccgctgcggcgagctcttctgcg

SEQ ID NO: 316 - protein, 125 aa, Zea mays
  misc_feature (1)..(125): Ceres Clone ID no. 1492169
  misc_feature (20)..(41): Pfam Name: zf-A20 Pfam Description: A20-like zinc finger
  misc_feature (104)..(125): Pfam Name: zf-AN1 Pfam Description: AN1-like Zinc finger
  misc_feature (1)..(125): Bit score of 101.6 for HMM based on sequences of Figure 2
  misc_feature (1)..(125): Functional Homolog Of SEQ ID NO. 237
MAQRDKKEEPTELRAPEITLCANNCGFPGNPATQNLCQSCFSASRSPSSPTSSSSSLASAASQPRPAALVVDAAAVEALAAPAAAAAGQGQATEAAARASASRCSSCRKRVGLTGFRCRCGELFC

SEQ ID NO: 317 - DNA, 449 bp, Glycine max
  misc_feature (1)..(449): Ceres Clone ID no. 1652996
  misc_feature (1)..(449): Encodes the peptide sequence at SEQ ID NO. 318
aaacaacccctttctcttctcttccaattacaaatcccttcttctctctctctctctttattctcatttcacaactcatcaatcccctctctctctctcccaaacgcaaaacctaagcatggctcagaaggcccagaaaaacgacactgagtttaaggtccccgaacccatcatcaacccctgcaccaccaccaccaccaccaccacctcgatttccgaaccttctagattcttcgatgcaaccacccccgccacttcatcgcgctccccaaagcgatccctccctctcgacgaggaatctcagacggaccaaacgacgtcttctgagcccaaacgcgccgtgaaccgctgctccggctgccggcggcgcgtgggactcacgggattccggtgccgctgcggggaccttttctgcgcagagcaccgctactccgaccgccacgactgct

SEQ ID NO: 318 - protein, 110 aa, Glycine max
  misc_feature (1)..(110): Ceres Clone ID no. 1652996
  misc_feature (18)..(37): Pfam Name: zf-A20 Pfam Description: A20-like zinc finger
  misc_feature (78)..(110): Pfam Name: zf-AN1 Pfam Description: AN1-like Zinc finger
  misc_feature (1)..(110): Bit score of 90.2 for HMM based on sequences of Figure 2
  misc_feature (1)..(110): Functional Homolog Of SEQ ID NO. 237
MAQKAQKNDTEFKVPEPIINPCTTTTTTTTSISEPSRFFDATTPATSSRSPKRSLPLDEESQTDQTTSSEPKRAVNRCSGCRRRVGLTGFRCRCGDLFCAEHRYSDRHDC

SEQ ID NO: 319 - DNA, 1135 bp, Zea mays
  misc_feature (1)..(1135): Ceres Clone ID no. 100861292
  misc_feature (1)..(1135): Encodes the peptide sequence at SEQ ID NO. 320
  misc_feature (666)..(666): m is a or c
ccctcgtctccgcacagagagggctcctcgctgccgtgtgccgggcttcactttcccctctcgtctcctctcccatggctcagcgcgacaagaaggtggaggagccgacggagctgcgcgcgccggagctcacgctgtgcgccaacagctgcggcttcccgggcaacccggccaccaacaacctctgccaggcctgcttcctggccgccacggcttcctcctccgcctccgcctccgtctcgccgccgccgccctcctcctcctcctcgtcgccggcggtgctccagttcgacgagcagcagcagcagcaaaatccgaggccgcgtgcgccggcggcgtccgggcccacggaggaaccgcccaggccggcccgggcgtcagctccggctccggctccggcgtcgtcctcgtccgtccgccggtgccagacctgccgcaagcgggtggggctcacgggcttccgctgccgctgcggagacctcttctgcggcgcgcaccgctactcggaccgccacgactgctgcttcgactacagggccgccggccgcgacgccatcgccagggacaaccccgtcgtgcgcgccgccaagatcgttaggttctaggcgtctcggatccggccggaggagctagctagctagctaggggcgggcacacacacgcacmcgcggtgatgggcgccgagatccgtcgccggtcctcatcgccctctatagtccgtccccccttcctctcctcctctccctctttgattgtcctctcctttttttcttgctgtcatctatttttattgcgagggggaaaaatgatttgatggtcaccgatcgatccgtccttggagggtgttggttatgtgttgatcgccatgctgttttagaaaattattccgtttacgaggacgacgatcgacgagaagcgtcgaaaaagagaggggggagagaatgaagacgaaaagaatagtgcgatgataacgttgttgttgttgtttgtagcggtggtggtggtggctggtggaagcgatatggttcggttcggttcggtgtgctcttgtcctgctgggaatcacaaattcctgttgaattttttttatatatctttgtataaaacgaaattgaaaatgtttatatggtgtgcc

SEQ ID NO: 320 - protein, 176 aa, Zea mays
  misc_feature (1)..(176): Ceres Clone ID no. 100861292
  misc_feature (117)..(155): Pfam Name: zf-AN1 Pfam Description: AN1-like Zinc finger
  misc_feature (21)..(42): Pfam Name: zf-A20 Pfam Description: A20-like zinc finger
  misc_feature (1)..(176): Bit score of 265.0 for HMM based on sequences of Figure 2
  misc_feature (1)..(176): Functional Homolog Of SEQ ID NO. 237
MAQRDKKVEEPTELRAPELTLCANSCGFPGNPATNNLCQACFLAATASSSASASVSPPPPSSSSSSPAVLQFDEQQQQQNPRPRAPAASGPTEEPPRPARASAPAPAPASSSSVRRCQTCRKRVGLTGFRCRCGDLFCGAHRYSDRHDCCFDYRAAGRDAIARDNPVVRAAKIVRF

SEQ ID NO: 321 - DNA, 731 bp, Panicum virgatum
  misc_feature (1)..(731): Ceres Clone ID no. 1875452
  misc_feature (1)..(731): Encodes the peptide sequence at SEQ ID NO. 322
aaacccatttccttcctgcctccacgacccagcccaggcccggcggtgcctctccctctcgtctccggatcggcaagagcccagctgctgccggattcacacgacacctcgtcgtctctctctctctctctctctctctctctctctctctcggcccatggcgcagcgcgacaagaaggtggaggagccgacggagctgcacgcgccggagctcacgctctgcgccaacagctgcggcttcccgggcaacccggcgaccaagaacctctgccagaactgcttcctggccgcctcggcctccgtgtcgccgccgtcgccctcctcctcctcgtcgccctcgccggcggtgttcgacaagccgcggccggcggccgcccctcccgccgtgtggccgccgttccccgcggccgccgaccggcccccggcgggccccgcggagtccccctccaaggcgccccggacgtcgtcgtcggtcaaccggtgccacagctgccagaagcgggtcgggctgacggggttccggtgccgctgcggcgagctcttctgcggcgcgcaccggtactcggaccgccacgactgcggctacgactacaagggcgtcgcccgggacgccatcgcccgggagaaccccgtcgtgcgcgccgccaagatcgtcaggttctgagagctggggagcaccggaggagaccacgcagctcagctccacgccgatcgtcgatccatctcccgcg

SEQ ID NO: 322 - protein, 168 aa, Panicum virgatum
  misc_feature (1)..(168): Ceres Clone ID no. 1875452
  misc_feature (109)..(147): Pfam Name: zf-AN1 Pfam Description: AN1-like Zinc finger
  misc_feature (21)..(42): Pfam Name: zf-A20 Pfam Description: A20-like zinc finger
  misc_feature (1)..(168): Bit score of 263.8 for HMM based on sequences of Figure 2
  misc_feature (1)..(168): Functional Homolog Of SEQ ID NO. 237
MAQRDKKVEEPTELHAPELTLCANSCGFPGNPATKNLCQNCFLAASASVSPPSPSSSSSPSPAVFDKPRPAAAPPAVWPPFPAAADRPPAGPAESPSKAPRTSSSVNRCHSCQKRVGLTGFRCRCGELFCGAHRYSDRHDCGYDYKGVARDAIARENPVVRAAKIVRF

SEQ ID NO: 323 - DNA, 829 bp, Zea mays
  misc_feature (1)..(829): Ceres Clone ID no. 296366
  misc_feature (1)..(829): Encodes the peptide sequence at SEQ ID NO. 324
gctcaggccagccgtgcggtagcttctccccccctcgtctccgcacagagagggctcctcgctgccgtgtgccggccttcactttcccctctcgtctcctctcctctcccatggctcagcgcgacaagaaggtggaggagccgacggagctgcgcgcgccggagctcacgctgtgcgccaacagctgcggcttcccgggcaacccggccaccaacaacctctgccaggcctgcttcctggccgccacggcttcctcctccgcctccgtctcgccgccgccgccctcctcctcctcgtctccggcggtgctccagttcgacgaccagcagcaaaatccgaggccgtgtgcgccggcggcgtccgggcccacggaggaaccgcccaggccggcccgggcgtcagcgccggcgtcgtcctcgtccgtccgccggtgccagacctgccgcaagcgggtggggctcacgggcttccgctgccgctgcggggacctcttctgcggcgcgcaccgctactcggaccgccacgactgctgcttcgactacagggccgccggccgcgacgccatcgccagggacaaccccgtcgtgcgcgccgccaagatcgttaggttctaggcgtctcggatccggccggaggagctagctagctagctaggggcgggcacacacacacacacacgcggtgatgggcgccgagatccgtcgccggtcctcatcgccctctatagtccgtcccccttcctctcctcctctccctctttgattgtcctctccttttcttctactgtcatctatttttattgcgagggggaaaaaatgatttgatggtc

SEQ ID NO: 324 - protein, 167 aa, Zea mays
  misc_feature (1)..(167): Ceres Clone ID no. 296366
  misc_feature (108)..(146): Pfam Name: zf-AN1 Pfam Description: AN1-like Zinc finger
  misc_feature (21)..(42): Pfam Name: zf-A20 Pfam Description: A20-like zinc finger
  misc_feature (1)..(167): Bit score of 263.0 for HMM based on sequences of Figure 2
  misc_feature (1)..(167): Functional Homolog Of SEQ ID NO. 237
MAQRDKKVEEPTELRAPELTLCANSCGFPGNPATNNLCQACFLAATASSSASVSPPPPSSSSSPAVLQFDDQQQNPRPCAPAASGPTEEPPRPARASAPASSSSVRRCQTCRKRVGLTGFRCRCGDLFCGAHRYSDRHDCCFDYRAAGRDAIARDNPVVRAAKIVRF

SEQ ID NO: 325 - DNA, 819 bp, Zea mays
  misc_feature (1)..(819): Ceres Clone ID no. 1468822
  misc_feature (1)..(819): Encodes the peptide sequence at SEQ ID NO. 326
gctcgctccctccctccctccctcccgcgcggatcacagaagggctcacggtcacggccggcctcccaattcgcaacctcgcctccgcctctcctcctaccccctccgaaaagcaagctccggccgggccgccaccaccaccaccgcgcgcgcgtgcacgcgctcccacacacagacagacagacagacagacagagtgagagacgcacggtggttcggggtctcccttctgccaggcgcacgaggagccatggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctccggcggccgcggccgcgggccagggccaggctacggaagccgcggcgagggcgtccgcgagccggtgctccagctgccggaagcgcgtggggctgacggggttccggtgccgctgcggcgagctcttctgcggcgcgcaccggtactcggaccggcacggctgcagctacgactacaggggcgccgcccgggacgccatcgcccgggagaacccggtggtgcagtggttgagggcccgaaacgatgaacagatgggttggttggattgggttaggtgtatgtatatgtcacacgcaactttggacagaactattatactagtact

SEQ ID NO: 326 - protein, 189 aa, Zea mays
  misc_feature (1)..(189): Ceres Clone ID no. 1468822
  misc_feature (104)..(142): Pfam Name: zf-AN1 Pfam Description: AN1-like Zinc finger
  misc_feature (20)..(41): Pfam Name: zf-A20 Pfam Description: A20-like zinc finger
  misc_feature (1)..(189): Bit score of 230.0 for HMM based on sequences of Figure 2
  misc_feature (1)..(189): Functional Homolog Of SEQ ID NO. 237
MAQRDKKEEPTELRAPEITLCANNCGFPGNPATQNLCQSCFSASRSPSSPTSSSSSLASAASQPRPAALVVDAAAVEALAAPAAAAAGQGQATEAAARASASRCSSCRKRVGLTGFRCRCGELFCGAHRYSDRHGCSYDYRGAARDAIARENPVVQWLRARNDEQMGWLDWVRCMYMSHATLDRTIILV

SEQ ID NO: 327 - DNA, 835 bp, Gossypium hirsutum
  misc_feature (1)..(835): Ceres Clone ID no. 1793946
  misc_feature (1)..(835): Encodes the peptide sequence at SEQ ID NO. 328
aaaaaaaaagccaaaaaacccccaaatctctccttgtctctcttttcatatccatttttttctctcttctatttcttcccttttgcagggcaaaggaaaaaaaaaagcaacaaaaaatggctcaaagaaccgaaaaagaagaaaccgagttcaaggtaccggaaaccttaacgctttgcgtcaatgattgtggtgttataggaaatccggccaccaataacatgtgtcaaaattgtttcaacgctacaacgcctaaatcaaccgctgccgtcgtctcctcttcaaccggtggtgctagttcaggtggtgtttcgatcctgaaccaaagatctaccacgtcgcgttctataaacaagcgatccgatctttctccgcctaaaacgacgacgtttgttaggagttctggttcgaggaacgatccggagcctggtacggaaaagaaggtggtgaaccggtgttctggatgtagaaaacgtgtcggtttgaccgggtttaggtgtcgatgtggtgaactgttttgtgccgatcatcggtactcggatcgacacgattgtagttatgattacaagacggtcggtcgtgaggccatcgctagggaaaatccggtggttaaagcggccaagataattaaagtctgatatatattttttatgaaatcctattaaaatcatattattcggaaacatttttcgacccggaattcggaacagctatggaaattcaacctcgatctcatcatcaatccatggaggaagatgacgacatatctcacaagatcgtttcaaattgaagaagattatagtatttttaattttacttaattttctttttttgg

SEQ ID NO: 328 - protein, 173 aa, Gossypium hirsutum
  misc_feature (1)..(173): Ceres Clone ID no. 1793946
  misc_feature (114)..(152): Pfam Name: zf-AN1 Pfam Description: AN1-like Zinc finger
  misc_feature (20)..(42): Pfam Name: zf-A20 Pfam Description: A20-like zinc finger
  misc_feature (1)..(173): Bit score of 294.4 for HMM based on sequences of Figure 2
  misc_feature (1)..(173): Functional Homolog Of SEQ ID NO. 237
MAQRTEKEETEFKVPETLTLCVNDCGVIGNPATNNMCQNCFNATTPKSTAAVVSSSTGGASSGGVSILNQRSTTSRSINKRSDLSPPKTTTFVRSSGSRNDPEPGTEKKVVNRCSGCRKRVGLTGFRCRCGELFCADHRYSDRHDCSYDYKTVGREAIARENPVVKAAKIIKV

SEQ ID NO: 329 - protein, 160 aa, Arabidopsis lyrata
  misc_feature (1)..(160): Public GI ID no. 297829802
  misc_feature (1)..(160): Arabidopsis lyrata subsp. lyrata
  misc_feature (101)..(140): Pfam Name: zf-AN1 Pfam Description: AN1-like Zinc finger
  misc_feature (26)..(48): Pfam Name: zf-A20 Pfam Description: A20-like zinc finger
  misc_feature (1)..(160): Bit score of 278.5 for HMM based on sequences of Figure 2
  misc_feature (1)..(160): Functional Homolog Of SEQ ID NO. 237
MAQRTEKEETEFKVLDTLTTTTTTTLCTNNCGVTANPATNNMCQKCFNASLVSAAAGVVESGSILKRSARSVNLRSSPAKVVIRTREIDAVKRDQQIVNRCSGCRKKVGLTGFRCRCGELFCSEHRYSDRHDCSYDYKTAGREAIARENPVVKAAKMVKV

SEQ ID NO: 330 - DNA, 500 bp, Brassica napus
  misc_feature (1)..(500): Ceres Clone ID no. 1094610
  misc_feature (1)..(500): Encodes the peptide sequence at SEQ ID NO. 331
  misc_feature (262)..(262): s is g or c
  misc_feature (269)..(269): n is a, c, t, g, unknown, or other
  misc_feature (467)..(467): y is t/u or c
acattccattcatttcctctctctctctctctctctcctctgattctctctatacgacccgtgagctcgccggaggagggtgaaaccaataaagatggcgcagaggacggagaaggaagagacggagttcaaggtcctcgaatccctgacgacccccgccaccgccacgaccacgctctgctcaaataactgcggcgttacagcgaatccagccaccaacaacatgtgtcagaaatgtttcaacgcttccatcgccgccgcsggcgtanactccggttcgacgttgaagagagcgtcgagatccgtcaatcttaggcccacgccagccaaagtcgtgatccgtcccagggagatcgatccggttaagagagatcagcagacggtaaaccggtgttccggttgtcggaagaaggtcgggctgaccgggttcagatgccgatgcggtgaccttttctgctccgagcacygttactccgatcgccatgagtgcagctacgact

SEQ ID NO: 331 - protein, 135 aa, Brassica napus
  misc_feature (1)..(135): Ceres Clone ID no. 1094610
  misc_feature (100)..(135): Pfam Name: zf-AN1 Pfam Description: AN1-like Zinc finger
  misc_feature (28)..(50): Pfam Name: zf-A20 Pfam Description: A20-like zinc finger
  misc_feature (1)..(135): Bit score of 172.0 for HMM based on sequences of Figure 2
  misc_feature (1)..(135): Functional Homolog Of SEQ ID NO. 237
  misc_feature (56)..(56): Xaa is any aa, unknown or other
  misc_feature (59)..(59): Xaa is any aa, unknown or other
  misc_feature (125)..(125): Xaa is any aa, unknown or other
MAQRTEKEETEFKVLESLTTPATATTTLCSNNCGVTANPATNNMCQKCFNASIAAXGVXSGSTLKRASRSVNLRPTPAKVVIRPREIDPVKRDQQTVNRCSGCRKKVGLTGFRCRCGDLFCSEHXYSDRHECSYD

SEQ ID NO: 332 - DNA, 470 bp, Brassica napus
  misc_feature (1)..(470): Ceres Clone ID no. 1084216
  misc_feature (1)..(470): Encodes the peptide sequence at SEQ ID NO. 333
  misc_feature (459)..(459): n is a, c, t, g, unknown, or other
atattccattcatttcctctctctcttctctctcaataccattcgtaagctcgccggagaaactcatcaataaagatggcgcagagaacggagaaggaagagacggagttcaaggtggtcctcgaaaccttgccgacgacgacaaccccgacgctctgctccaacaactgcggcgtcaccgcgagtccatcaaccaacaacatgtgccagaaatgtttcaacgcctccgtcgccggtatagatccaaatccgatcgtgaaaagatcagccagatccgtcagtctccggtcaacgccagccagagccgtgatccgtcccagggagaccgatccggttaagagagaccaccatcagcagaccgtaaaccgatgctccggctgtcggaagaaggtcgggttgaccggattcagatgccgatgcggcgaccttttctgctccgagcatcggtattcggatcgncacgagtgcag

SEQ ID NO: 333 - protein, 131 aa, Brassica napus
  misc_feature (1)..(131): Ceres Clone ID no. 1084216
  misc_feature (99)..(131): Pfam Name: zf-AN1 Pfam Description: AN1-like Zinc finger
  misc_feature (25)..(49): Pfam Name: zf-A20 Pfam Description: A20-like zinc finger
  misc_feature (1)..(131): Bit score of 147.0 for HMM based on sequences of Figure 2
  misc_feature (1)..(131): Functional Homolog Of SEQ ID NO. 237
  misc_feature (128)..(128): Xaa is any aa, unknown or other
MAQRTEKEETEFKVVLETLPTTTTPTLCSNNCGVTASPSTNNMCQKCFNASVAGIDPNPIVKRSARSVSLRSTPARAVIRPRETDPVKRDHHQQTVNRCSGCRKKVGLTGFRCRCGDLFCSEHRYSDXHEC

SEQ ID NO: 334 - DNA, 819 bp, Gossypium hirsutum
  misc_feature (1)..(819): Ceres Clone ID no. 100041169
  misc_feature (1)..(819): Encodes the peptide sequence at SEQ ID NO. 335
ctaattttctctccaaccaaacactaattctctccttcctctccatcctccccttcaaatttgttgttttccttttcctccttcgaaatcacctcaaggagatatggctcaaagaaccgaaaaagaagagactgaattcaaagtacctgaaaccctgactctatgcgttaacaactgcggggttacggggaatccagccaccaacaacatgtgccagaaatgttttagttccaccacggccgccacatcctcctcttcctcttccaccaacaacaccgctacttccgctaccgacgataaatcctcgagatctacgccgactcgttcacaggacaaccgatccgactccgctccgcctacaacagctgcaacaacggcaacagcaacagcaacgacgaatagtccgatgactgcttcaaatcggtctggatacgataccgcggaaaagaagtcggtgaatcgatgttctggttgcagaaaacgcgttgggttgacggggttccggtgtcgatgcggggagcttttctgttcggaccatcggtactcggatcgacacgattgtagctacgactacaaggcggcgggtcgcgaagccatcgctagggaaaatcccgtggttaaagcagccaagattatcagagtttagtttttaccaaatggatccaaattaaattaaataaactattcaaaacatttttcgacctgaaaatagcaagttgtggagatctatgctcgatctcaaaaagaaaaagaaaaaagtaaaaaaagactgtttcagagagggagaaatgagtcggtcgaaatcttgattgcaaaaat

SEQ ID NO: 335 - protein, 180 aa, Gossypium hirsutum
  misc_feature (1)..(180): Ceres Clone ID no. 100041169
  misc_feature (121)..(160): Pfam Name: zf-AN1 Pfam Description: AN1-like Zinc finger
  misc_feature (20)..(41): Pfam Name: zf-A20 Pfam Description: A20-like zinc finger
  misc_feature (1)..(180): Bit score of 305.6 for HMM based on sequences of Figure 2
  misc_feature (1)..(180): Functional Homolog Of SEQ ID NO. 237
MAQRTEKEETEFKVPETLTLCVNNCGVTGNPATNNMCQKCFSSTTAATSSSSSSTNNTATSATDDKSSRSTPTRSQDNRSDSAPPTTAATTATATATTNSPMTASNRSGYDTAEKKSVNRCSGCRKRVGLTGFRCRCGELFCSDHRYSDRHDCSYDYKAAGREAIARENPVVKAAKIIRV

SEQ ID NO: 336 - DNA, 533 bp, Glycine max
  misc_feature (1)..(533): Ceres Clone ID no. 1619774
  misc_feature (1)..(533): Encodes the peptide sequence at SEQ ID NO. 337
cttcgtcctctctctcacatcacaatttcataaaaaacctctttttaagtttcttgcttctttctctctgaaagaaaattgaagtcctaaccagttggctcttttgttttatcgttctccatggctcagaaaaccgagaaagaagaaaccgacttcaaagttccggaaacgattacgctttgcgtcaacaactgcggcgtcaccggaaaccctgccacgaataacatgtgccagaagtgcttcactgcctctaccgccaccacttccggcgccggaggtgccggaatagcttctccggcgaccagatccggcgtctccgcgcgtcctcagaagagatcttttcctgaagagccctcgccggtggcggatcctccttcttcggaccagacgacgccgtcggaggcgaagcgcgtggtcaaccgctgctccggatgccggcggaaagtcggactcaccggattccggtgccggtgcggcgagctcttctgcgccgagcaccggtactccgacccgcacgactgcagctatgacta

SEQ ID NO: 337 - protein, 137 aa, Glycine max
  misc_feature (1)..(137): Ceres Clone ID no. 1619774
  misc_feature (102)..(137): Pfam Name: zf-AN1 Pfam Description: AN1-like Zinc finger
  misc_feature (20)..(41): Pfam Name: zf-A20 Pfam Description: A20-like zinc finger
  misc_feature (1)..(137): Bit score of 193.8 for HMM based on sequences of Figure 2
  misc_feature (1)..(137): Functional Homolog Of SEQ ID NO. 237
MAQKTEKEETDFKVPETITLCVNNCGVTGNPATNNMCQKCFTASTATTSGAGGAGIASPATRSGVSARPQKRSFPEEPSPVADPPSSDQTTPSEAKRVVNRCSGCRRKVGLTGFRCRCGELFCAEHRYSDPHDCSYD

SEQ ID NO: 338 - protein, 164 aa, Phyllostachys edulis
  misc_feature (1)..(164): Public GI ID no. 218685692
  misc_feature (105)..(144): Pfam Name: zf-AN1 Pfam Description: AN1-like Zinc finger
  misc_feature (20)..(41): Pfam Name: zf-A20 Pfam Description: A20-like zinc finger
  misc_feature (1)..(164): Bit score of 281.2 for HMM based on sequences of Figure 2
  misc_feature (1)..(164): Functional Homolog Of SEQ ID NO. 237
MAQRDKKEEPTELRAPEITLCANSCGFPGNPATQNLCQNCFLAASASTSSPPSPSSSSSSSSSSLPGLSPVVDKPRPAPMELASPAVDRAPAVEVKAGKTSVNRCSSCRKRVGLTGFRCRCGELFCGEHRYSDRHGCSYDYKAAARDAIARDNPVVRAAKIVRF

SEQ ID NO: 339 - protein, 163 aa, Phyllostachys vivax
  misc_feature (1)..(163): Public GI ID no. 295148937
  misc_feature (104)..(143): Pfam Name: zf-AN1 Pfam Description: AN1-like Zinc finger
  misc_feature (20)..(41): Pfam Name: zf-A20 Pfam Description: A20-like zinc finger
  misc_feature (1)..(163): Bit score of 278.5 for HMM based on sequences of Figure 2
  misc_feature (1)..(163): Functional Homolog Of SEQ ID NO. 237
MAQRDKKEEPTELRAPEITLCANSCGFPGNPATQNLCQNCFLAASASTSSPPSPSSSSSSSSSLPGLSPVVDKPRPAPVELASPAVDRVPAVEVKAGKTSVNRCSSCRKRLGLTGFRCRCGELFCGEHRYSDRHGCSYDYKAAARDAIARDNPVVRAAKIVRF

SEQ ID NO: 340 - DNA, 1019 bp, Panicum virgatum
  misc_feature (1)..(1019): Ceres Clone ID no. 1783953
  misc_feature (1)..(1019): Encodes the peptide sequence at SEQ ID NO. 341
ctcgctcctcgccgatcacagccgcgacctcctccccaatcccgatttcgcgagctcgtccccccgcttcccggcctctcccgtctccccgccccccgcccgccctccgagaggcgaagctccgggccgcgccaccgcgcaggcacacccaaggcagcaggcgcggttccttccaccaggtgcgcgggcggcggcatggcgcagcgcgacaagaaggaggagcccacggagctccgggcgccggagatcacgctctgcgccaacaactgcggcttcccggggaacccggctacgcagaacctctgccagagctgcttctcggcggccacggcgtcgatgtcgtcgccgacctcctcctcgtcctccccggctcccgcgccggccgcgacgccccagccgaggccggcgccggtggagctggcctccccggccgacgcggccgtggcggccccggctccggaggcggcgaggacgccggcgaaccggtgctcgagctgccggaagcgggtggggctcacggcgttccggtgccggtgcggcgagctgttctgcggcgcgcaccggtactcggaccggcacggctgcagctacgactacaagggcgccgccagggacgccatcgcccgggagaacccggtggtgcgcgccgccaagatcgttaggttctgatcgtcgacggagtcaaaatccctccatccagaggatacaaagcaagcaagcaaggaaaacaaagaggagacacacatccacggaaatggaaggcctttcccttggtgttactatgctgttcttcgaagcgtttgattttcaatctcctttcttttttacgattttcaaatggaagaaaaacgggaagaaaagaggtggacaaagaatagtgtaataataatgggggtgatgatgccgccgcggtggttgagggcaaaaggatgaacaaaatggattggatgtatgtacctgtcagtcgcaaagctttgtgcaaaaaatattatacatttctatctttcgtacagaaaccc

SEQ ID NO: 341 - protein, 157 aa, Panicum virgatum
  misc_feature (1)..(157): Ceres Clone ID no. 1783953
  misc_feature (98)..(137): Pfam Name: zf-AN1 Pfam Description: AN1-like Zinc finger
  misc_feature (20)..(41): Pfam Name: zf-A20 Pfam Description: A20-like zinc finger
  misc_feature (1)..(157): Bit score of 271.9 for HMM based on sequences of Figure 2
  misc_feature (1)..(157): Functional Homolog Of SEQ ID NO. 237
MAQRDKKEEPTELRAPEITLCANNCGFPGNPATQNLCQSCFSAATASMSSPTSSSSSPAPAPAATPQPRPAPVELASPADAAVAAPAPEAARTPANRCSSCRKRVGLTAFRCRCGELFCGAHRYSDRHGCSYDYKGAARDAIARENPVVRAAKIVRF

SEQ ID NO: 342 - protein, 172 aa, Sorghum bicolor
  misc_feature (1)..(172): Public GI ID no. 242045152
  misc_feature (113)..(151): Pfam Name: zf-AN1 Pfam Description: AN1-like Zinc finger
  misc_feature (20)..(41): Pfam Name: zf-A20 Pfam Description: A20-like zinc finger
  misc_feature (1)..(172): Bit score of 272.7 for HMM based on sequences of Figure 2
  misc_feature (1)..(172): Functional Homolog Of SEQ ID NO. 237
MAQRDKKEEPTELRAPEITLCANNCGFPGNPATQNLCQSCFSAATASRSSSPSSPTSSSSASAVSQPRPAALVDAAAVELLASADAAAVGQSMEVVAAAPAATAARSSAVNRCSSCRKRVGLTGFRCRCGELFCGAHRYSDRHGCSYDYKGAGRDAIARENPVVRAAKIVRF

SEQ ID NO: 343 - protein, 163 aa, Zea mays
  misc_feature (1)..(163): Public GI ID no. 223972713
  misc_feature (104)..(143): Pfam Name: zf-AN1 Pfam Description: AN1-like Zinc finger
  misc_feature (20)..(41): Pfam Name: zf-A20 Pfam Description: A20-like zinc finger
  misc_feature (1)..(163): Bit score of 257.9 for HMM based on sequences of Figure 2
  misc_feature (1)..(163): Functional Homolog Of SEQ ID NO. 237
MAQRDKKEEPTELRAPEITLCANNCGFPGNPATQNLCQSCFSASRSPSSPTSSSSSLASAASQPRPAALVVDAAAVEALAAPAAVAAAAGQATEAAARASASRCSSCRKRVGLTGFRCRCGELFCGAHRYSDRHGCSYDYKGAARDAIARENPVVRAAKVVRF

SEQ ID NO: 344 - protein, 161 aa, Hordeum vulgare
  misc_feature (1)..(161): Public GI ID no. 326494504
  misc_feature (1)..(161): Hordeum vulgare subsp. vulgare
  misc_feature (102)..(141): Pfam Name: zf-AN1 Pfam Description: AN1-like Zinc finger
  misc_feature (23)..(44): Pfam Name: zf-A20 Pfam Description: A20-like zinc finger
  misc_feature (1)..(161): Bit score of 253.8 for HMM based on sequences of Figure 2
  misc_feature (1)..(161): Functional Homolog Of SEQ ID NO. 237
MAQRDKKVEEPTEVHLHAAEITLCANSCGFPGNPATKNLCQNCFLASSSSPPSPSSSPPAFPLFDKPRPAAAASPALQAPPVYMAVDRPADPKASKSSVNRCHNCRKRVGLTGFRCRCGEMFCGAHRYSDRHDCSYDYKSAARDAIARENPVVRAAKIVRF

SEQ ID NO: 345 - protein, 163 aa, Hordeum vulgare
  misc_feature (1)..(163): Public GI ID no. 326515226
  misc_feature (1)..(163): Hordeum vulgare subsp. vulgare
  misc_feature (104)..(143): Pfam Name: zf-AN1 Pfam Description: AN1-like Zinc finger
  misc_feature (21)..(42): Pfam Name: zf-A20 Pfam Description: A20-like zinc finger
  misc_feature (1)..(163): Bit score of 263.6 for HMM based on sequences of Figure 2
  misc_feature (1)..(163): Functional Homolog Of SEQ ID NO. 237
MAQRDHKQEEPTELRAPEITLCANSCGFPGNPATQNLCQNCFLAGPASTSPSSSSSSLPGASVSTPVLDRPRPAPVDAELAHPAVDYRATATEAKPARTSVNRCSSCRKRVGLTGFRCRCGDVFCGEHRYSDRHGCSYDYKAAARDAIARDNPVVRAAKIVRF

SEQ ID NO: 346 - protein, 160 aa, Zea mays
  misc_feature (1)..(160): Public GI ID no. 163838754
  misc_feature (101)..(140): Pfam Name: zf-AN1 Pfam Description: AN1-like Zinc finger
  misc_feature (20)..(41): Pfam Name: zf-A20 Pfam Description: A20-like zinc finger
  misc_feature (1)..(160): Bit score of 252.2 for HMM based on sequences of Figure 2
  misc_feature (1)..(160): Functional Homolog Of SEQ ID NO. 237
MAQRDKKEEPTELRAPEITLCANNCGFPGNPATQNLCQSCFSASRSPSSPTSSSSSLASAASQPRPAALVVDAAAVDALAAPAAAAGQATEAAARASASRCSSCWKRVGLTGFRCRCGELFCGAHRYSDRHGCSYDYKGAARDAIAREDPVVRAAKVVRF

SEQ ID NO: 347 - protein, 174 aa, Zea mays
  misc_feature (1)..(174): Public GI ID no. 163838756
  misc_feature (115)..(153): Pfam Name: zf-AN1 Pfam Description: AN1-like Zinc finger
  misc_feature (21)..(42): Pfam Name: zf-A20 Pfam Description: A20-like zinc finger
  misc_feature (1)..(174): Bit score of 265.4 for HMM based on sequences of Figure 2
  misc_feature (1)..(174): Functional Homolog Of SEQ ID NO. 237
MAQRDKKVEEPTELRAPELTLCANSCGFPGNPATNNLCQACFLAATASASASVSPPPPSSSSSPAVLQFDDQQQQQQQQNPRPRAPAASGPTEEPPRPARAPAPAPASSSSVRRCQTCRKRVGLTGFRCRCGDLFCGAHRYSDRHDCCFDYRAAGRDAIARDNPVVRAAKIVRF

SEQ ID NO: 348 - protein, 163 aa, Zea mays
  misc_feature (1)..(163): Public GI ID no. 163838762
  misc_feature (104)..(142): Pfam Name: zf-AN1 Pfam Description: AN1-like Zinc finger
  misc_feature (20)..(41): Pfam Name: zf-A20 Pfam Description: A20-like zinc finger
  misc_feature (1)..(163): Bit score of 263.3 for HMM based on sequences of Figure 2
  misc_feature (1)..(163): Functional Homolog Of SEQ ID NO. 237
MAQRDKKEEPTELRAPEIALCANNCGFPGNPATQNLCQSCFSASRSSSSSSQPSPTSSPSASAPAAAVPQPRPALLDAALQLAPPAAAAGQPVEASARTSANRCSSCRKRVGLTGFRCRCGDLFCGAHRYSDRHGCRYDYRGAARDAIARENPVVRAAKIVRF

SEQ ID NO: 349 - protein, 163 aa, Hordeum vulgare
  misc_feature (1)..(163): Public GI ID no. 326523409
  misc_feature (1)..(163): Hordeum vulgare subsp. vulgare
  misc_feature (104)..(143): Pfam Name: zf-AN1 Pfam Description: AN1-like Zinc finger
  misc_feature (21)..(42): Pfam Name: zf-A20 Pfam Description: A20-like zinc finger
  misc_feature (1)..(163): Bit score of 260.4 for HMM based on sequences of Figure 2
  misc_feature (1)..(163): Functional Homolog Of SEQ ID NO. 237
MAQRDHKQEEPTELRAPEITLCANSCGFPGNPATQNLCQNCFLAGPASTSPSSSSSSLPGASVSTPVLDRPRPAPVDAELAHPAVDYRATATEAKPARTSVNRCSSCRKRVGLTGFRCRCGDVFCGGHRYSDRHGCSYDYKAAARDAIARDNPVVRAAKIVRF

SEQ ID NO: 350 - protein, 140 aa, Ricinus communis
  misc_feature (1)..(140): Public GI ID no. 255544230
  misc_feature (1)..(13): Pfam Name: zf-A20 Pfam Description: A20-like zinc finger
  misc_feature (81)..(119): Pfam Name: zf-AN1 Pfam Description: AN1-like Zinc finger
  misc_feature (1)..(140): Bit score of 165.0 for HMM based on sequences of Figure 2
  misc_feature (1)..(140): Functional Homolog Of SEQ ID NO. 237
MCQKCFNATTSTSTSNSTTSTTTTAIISASAGSSGSGILTISPRSSASLMVIRDPQPETSESTADREKNDVLVAKRDVNRCSGCRRKVGLTGFRCRCGDLFCWEHRYSDRHDCSYDYKTVGREAIARENPVVKAAKIVRV

SEQ ID NO: 351 - protein, 160 aa, Solanum lycopersicum
  misc_feature (1)..(160): Public GI ID no. 222822669
  misc_feature (17)..(35): Pfam Name: zf-A20 Pfam Description: A20-like zinc finger
  misc_feature (103)..(140): Pfam Name: zf-AN1 Pfam Description: AN1-like Zinc finger
  misc_feature (1)..(160): Bit score of 178.0 for HMM based on sequences of Figure 2
  misc_feature (1)..(160): Functional Homolog Of SEQ ID NO. 237
MAAQKREKEETELKVPESIPLCSPTLPVPSPSPPSTTTHLSVAVISNLKRSDRSSTESIDLKVSSMDDQSRSTSAASPESMDLVGRKTGVKRQREANRSSGMGCRRKVGLMPFRCRCGEVFCSEHRYSDRHDCSYDYKAAGREAIAKENPVVKAAKILKV

SEQ ID NO: 352 - DNA, 1904 bp, Zea mays
  misc_feature (1)..(1904): Ceres Clone ID no. 375578
  misc_feature (1)..(1904): Encodes the peptide sequence at SEQ ID NO. 353
acatcctaatcgaaaacccggtttattttttcttcgtcctggatgcgtcggtcgcgtgtttgatctgactaagccgcggaggagggtgctagatgtccgtgcggtgggcggtggctcccgagggcgaccggagttaggtccttgccgccttcagtgcggtggggaagcgagacattgaaggcgcagaacccaaagaatgggtaagagaggaaagtggtttagtgcggtgaagaaagtcttcagctcctccgatccagatggaaaggaagccaaggcccagaaggcagacaaatcgaaatccaagaggagatggccatttggaaagtccaagcactcggagccttccatatcgacggtgccaggcactgctccagcagtagctccgttgccatcaccaccagcaactcagccccactctctggagatcaaagatgtcaatccagttgaaacagacagtgagcagaacaagcatgcctactccgttgcgcttgcgtctgctgtcgctgctgaagctgcagcagttgctgcccaggctgctgcggaagttgtccgcctcacagcagttaccacggctgcaccaaagatgcctgttagttcgagggaataacttgccgccaccaagattcagactgccttcaggggttatctggcaaggagagcattgcgtgcactaagagggctagttagattgaagtcgcttgttgatggaaatgctgtcaaacgccaaaccgctcacaccttgcaatgcacacaagcaatgacaagagttcaaactcaaatctactctagaagggtgaagttggaggaggagaaacaggctcttcaaagacaactccaattgaaacatcaaagggaacttgagaaaatgaagattgatgaagattgggatcacagccatcaatccaaagagcaaattgaggccaacctaatgatgaaacaggaagctgcactgaggcgagagagagcacttgcatatgcattttctcaccagtggaggaattctggtcgaactataacccctacttttacggaacctgggaaccccaactggggctggagctggatggagcgctggatgacagcaagaccatgggagagtcggttggcggcggcatcggacaaggaccctaaagaacgtgctgtgacaaagaatgcgagcaccagtgctgttcgagtacctgtatcccgtgccatctcgattcagagaccagcaacaccaaacaagtcgagccgcccaccaagccggcagtcactttcaaccccgccatcgaagaccccgtcagcctcaggaaaggccaggccggcaagtccaaggaacagttggctgtacaaggaggatgacctgaggagcatcacgagcatccgctccgagcgcccaaggaggcagagcacgggtggaggctcggtccgggacgataccagcctgaccagcacaccacctctccccagctacatgcagtcgaccgagtctgcacgggccaagtctcggtaccgcagtctactactgactgagaagcttgaggttcctgagagagcgcctctggcccactccgttgtcaagaagcgcctgtcgttccccgtcgtcgagaagccaagcgttgtgccgacagagaagcccagggaaagagtgaggcgccattccgaccctccgaaggtcgatcctgcgacgctcaaggatgcccctgctgcctgaccagtgaccaggccttatgtgattgttaggtttcgtgctcttttaacaccgtgatgtattatctgagttaggttgctttgttcgtgtcatcgtatgatctgtccgggttgattttgagacagttctaactgtgtttacagacaatgcgtgatgctaaatgtatgtgtggttggttggctttaaatgtactgatatgatagtatttgatttc

SEQ ID NO: 353 - protein, 498 aa, Zea mays
  misc_feature (1)..(498): Ceres Clone ID no. 375578
  misc_feature (139)..(157): Pfam Name: IQ Pfam Description: IQ calmodulin-binding motif
  misc_feature (1)..(498): Bit score of 1275.2 for HMM based on sequences of Figure 1
  misc_feature (1)..(498): in Figure 1
MGKRGKWFSAVKKVFSSSDPDGKEAKAQKADKSKSKRRWPFGKSKHSEPSISTVPGTAPAVAPLPSPPATQPHSLEIKDVNPVETDSEQNKHAYSVALASAVAAEAAAVAAQAAAEVVRLTAVTTAAPKMPVSSREELAATKIQTAFRGYLARRALRALRGLVRLKSLVDGNAVKRQTAHTLQCTQAMTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 354 - DNA, 1918 bp, Arabidopsis thaliana
  misc_feature (1)..(1918): Ceres Clone ID no. 106263
  misc_feature (1)..(1918): Encodes the peptide sequence at SEQ ID NO. 355
acaaatactcttcttcacacagctttgaatccatctgtcttctcctctctctctcttctccatttgcaattacgataatgtgaaagcaataagaagaggaaaagttatcttcgcacctcagcaaagatccaatcgattcgattcttaagctttttcgtcttctccgataaggtcactacttagaagccgcgttgtggtttagttgactcctccaggttttatcttcaagctttttcgtctatcagatctggtgtcactgtcttctcataggattacatagagatggggaaaaaagctaaatggttttcaagtgttaagaaagcattcagcccagattcaaagaagtcgaagcaaaaattggctgagggacaaaatggtgttatctctaatcctcctgttgtggataatgttagacaatcttcttcttctcctcctcctgctcttgctcctcgtgaagtgagagtagctgaagtgattgttgaacggaacagggatctttcacctccttctacagcagatgctgtgaatgttacagctactgatgttcctgtagttccatcttcatctgctcctggtgttgttcgtcgcgctacacctactcgatttgctggaaagtcaaacgaagaagccgctgctatcttgatccagactatatttagaggttatttggcaaggagagcgttgcgggcaatgaggggtttggtcagacttaagttattgatggaaggatctgttgttaagcggcaagctgcaaatactctaaaatgtatgcagactctctctcgtgtacagtcgcagatccgagctaggagaatcaggatgtcagaagagaatcaggctcgccagaaacaactccttcagaaacatgctaaagagctagctggcttgaagaacggggataactggaatgatagcattcaatcaaaggagaaagttgaagcgaatttgctaagcaagtacgaggcaacaatgagaagggaaagggcattggcttattcatactctcatcagcaaaactggaagaacaactctaaatctggaaacccgatgttcatggatccaagcaacccgacatggggttggagctggttggagagatggatggctggtaggccactagagagttccgagaaagaacaaagcaacagcaacaatgacaatgctgcctcggtcaagggctctattaaccgcaacgaagctgcaaaatctctaacccgcaatggctcaactcaaccaaacacaccatcatccgcaagagggaccccaagaaacaaaaacagtttcttctcacctccaactccctcaaggctaaaccaatcctcgaggaaatccaatgacgacgactccaaaagcacaatctcggtcctgtccgagaggaaccgcagacacagcattgctggttcatcagtcagagacgatgagagcctcgctggctcaccagctctcccgagctacatggttccaactaaatcagctcgagccaggctcaagccccaaagcccattaggtggtaccacacaggaaaacgaagggttcacagacaaggcatcagctaagaaacggctctcgtatccaacttcgcctgcattgcctaaaccacggcggttctcagctccccctaaggtggagagtggcggcgttaccgtgaccaacggagcaggcagctgaggtattttatttaatataattattttcccacttatgaatgtgtccgagattgttgtctcttatgtgttcccttcatttcgtaattcatttgtgcagtgtaagcgccagtcatttatttttttactataataaattttataaccttttaaaattcatgttcttttgtttctttgaatatttaagttatttttattaatgttggatgaattggaatatgatgatgttatttgtattgtaatgcagatccttt

SEQ ID NO: 355 - protein, 461 aa, Arabidopsis thaliana
  misc_feature (1)..(461): Ceres Clone ID no. 106263
  misc_feature (116)..(135): Pfam Name: IQ Pfam Description: IQ calmodulin-binding motif
  misc_feature (1)..(461): Bit score of 1103.4 for HMM based on sequences of Figure 1
  misc_feature (1)..(461): Bit score of 1103.4 for HMM based on sequences of Figure 1
  misc_feature (1)..(461): Functional Homolog Of SEQ ID NO. 353
  misc_feature (1)..(461): in Figure 1
  misc_feature (88)..(88): Xaa is any aa, unknown or other
  misc_feature (180)..(180): Xaa is any aa, unknown or other
  misc_feature (243)..(243): Xaa is any aa, unknown or other
  misc_feature (370)..(370): Xaa is any aa, unknown or other
  misc_feature (377)..(377): Xaa is any aa, unknown or other
MGKKAKWFSSVKKAFSPDSKKSKQKLAEGQNGVISNPPVVDNVRQSSSSPPPALAPREVRVAEVIVERNRDLSPPSTADAVNVTATDXPVVPSSSAPGVVRRATPTRFAGKSNEEAAAILIQTIFRGYLARRALRAMRGLVRLKLLMEGSVVKRQAANTLKCMQTLSRVQSQIRARRIRXSEENQARQKQLLQKHAKELAGLKNGDNWNDSIQSKEKVEANLLSKYEATMRRERALAYSYSHXQNWKNNSKSGNPMFMDPSNPTWGWSWLERWMAGRPLESSEKEQSNSNNDNAASVKGSINRNEAAKSLTRNGSTQPNTPSSARGTPRNKNSFFSPPTPSRLNQSSRKSNDDDSKSTISVLSERNRRHXIAGSSVXDDESLAGSPALPSYMVPTKSARARLKPQSPLGGTTQENEGFTDKASAKKRLSYPTSPALPKPRRFSAPPKVESGGVTVTNGAGS

SEQ ID NO: 356 - DNA, 1083 bp, Zea mays
  misc_feature (1)..(1083): Ceres Clone ID no. 335348
  misc_feature (1)..(1083): Encodes the peptide sequence at SEQ ID NO. 357
aacccccgccgtatcggtcttgttcgttgtcctgccagatacagataggtggctaccactggctcgcgtgacctgttggcttgcttgctcctctccaggttcaggcaggggagagtgcctgtttcgagggggcgtggagcggagccggagccatggggaagaagggcaagtggttcggcgccgtcaagaaggtcttcagccctgaatccaaggagaagaaagaggagagcaacattgaccggggatccgttaagagcatgagcttgaaccttggagagggtgagatcacaaaagctttcaaccgccgggactcaaagctagaaaagccatcgccgccaactccaagaccggcccgtccaacttccaggcattcccctttgacgccctctgctagagtggcaccgatacctgcgaggagaaaatctgtcacgcccaagaacgggctttcacaggtggacgatgacgcgaggagcgtgctcagtgtgcagtctgagcggccaaggaggcacagtatagccacctcgactgtgcgggacgacgagagcctcacgagctccccgtcgctcccaagctacatggttcccacagaatctgcaagggccaaatctcgcctccagggttcagcaatggccaatggcgcagagacacctgagaaaggaggctcaactggaccagccaagaagaggttatccttccagggtggaactgcggctgcctcgccaatgcgacgacattctggtcctcccaaggtggagatcgcgccaccacaaccagaggccttggtagtcaatggtggaagcaagtgacacatatgtgatgagtaccaggatgagaaacggattatgaagatattagtttcattttcatccatgaatagaagttaaaagtggtatcatatctatgaatggtttcaattgtttttctgttacaaccacattatttgctatatacgattcacagtacctgccagttgattccattggttgtttctgtaaaacaaatatcaatttgtcactagaatctgtgatgtttgtatgtaaacagatcctctatttatgtgagacatatatttcttttctttcg

SEQ ID NO: 357 - protein, 217 aa, Zea mays
  misc_feature (1)..(217): Ceres Clone ID no. 335348
  misc_feature (135)..(157): Pfam Name: IQ Pfam Description: IQ calmodulin-binding motif
  misc_feature (1)..(217): Bit score of 322.6 for HMM based on sequences of Figure 1
  misc_feature (1)..(217): Functional Homolog Of SEQ ID NO. 353
  misc_feature (1)..(217): in Figure 1
MGKKGKWFGAVKKVFSPESKEKKEESNIDRGSVKSMSLNLGEGEITKAFNRRDSKLEKPSPPTPRPARPTSRHSPLTPSARVAPIPARRKSVTPKNGLSQVDDDARSVLSVQSERPRRHSIATSTVRDDESLTSSPSLPSYMVPTESARAKSRLQGSAMANGAETPEKGGSTGPAKKRLSFQGGTAAASPMRRHSGPPKVEIAPPQPEALVVNGGSK

SEQ ID NO: 358 - protein, 500 aa, Oryza sativa
  misc_feature (1)..(500): Public GI ID no. 115440873
  misc_feature (1)..(500): Oryza sativa Japonica Group
  misc_feature (144)..(162): Pfam Name: IQ Pfam Description: IQ calmodulin-binding motif
  misc_feature (1)..(500): Bit score of 1280.7 for HMM based on sequences of Figure 1
  misc_feature (1)..(500): Functional Homolog Of SEQ ID NO. 353
  misc_feature (1)..(500): in Figure 1
MGKKGNWFSAVKKVFSSSDPDGREAKIEKADKSRSRRKWPFGKSKKSDPWTSTVAVPTSTAPPPQPPPPPPTHPIQPQPEEIKDVKAVETDSEQNKHAYSVALASAVAAEAAAVAAQAAAEVVRLTTATTAVPKSPVSSKDELAAIKIQTAFRGYLARRALRALRGLVRLKSLVDGNAVKRQTAHTLHCTQTMTRVQTQIYSRRVKMEEEKQALQRQLQLKHQRELEKMKIDEDWDHSHQSKEQVETSLMMKQEAALRRERALAYAFSHQWKNSGRTITPTFTDQGNPNWGWSWMERWMTSRPWESRVISDKDPKDHYSTKNPSTSASRTYVPRAISIQRPATPNKSSRPPSRQSPSTPPSRVPSVTGKIRPASPRDSWLYKEDDLRSITSIRSERPRRQSTGGASVRDDASLTSTPALPSYMQSTESARAKSRYRSLLTDRFEVPERVPLVHSSIKKRLSFPVADKPNGEHADKLMERGRRHSDPPKVDPASLKDVPVS

SEQ ID NO: 359 - DNA, 1695 bp, Triticum aestivum
  misc_feature (1)..(1695): Ceres Clone ID no. 826796
  misc_feature (1)..(1695): Encodes the peptide sequence at SEQ ID NO. 360
ataggacttcacagacagactgactcaatcctaacccaatccctcccatgcttccatctactctagcagaaattgcagaggaggttggccgccgccggctccagcgcaggcgcagcctacccgcgggatctgacgccctccgcctcctacctcgaggcacgcgcctcaggctcagctcccccgcccgccctcccccgctaccccgacgacttccaagaggaggagcatgaaattgagcatgtcgccgccgcgccagcgccagcgccagccacggatgcgccgctacctgcccctcctgccgccgcaccaccacaggttcaggctgccattgcgccggcttcttcctcttgtgtcatgtccagggagctcgccgccaccaagatccagaccgccttccgaggtcacctggcaagaagggcgctgcgggcattgaaaggcctggtcagactcaagtcgctggtccaaggccactccgtcaagcgccaggccaccagcacgcttcgctgcatgcagactctgtcccgggtccagtccaagatacggacgaggaggatcaagatggccgaggagaaccaggcccttcagcgccagctcttgttgaaccaggaactagagactctcaggatgggagatcagtggaataccagcctgcagtccaaggagcaaatcgaggcgagcctcgtgagcaggcaagaggccgcggctagaagagaacgggctctcgcatacgcattctcccaccagtggaagagcacctcaaggtctgccaacccgatgttcgtggacccgagtaacccgcactggggctggagctggctggagcggtggatggcgtcgaggccgttcgacggccgcaacggggcgtccgagaaggagggcagcagcgtcgaccgcacgtcggtgcacagcaccagcctgagcatgaacctcggagaaggtgagacggtcacaaaggcggacaaccaggtggtggactctttgaagccgaatgatgataagccgccgccgctttcgactccgaagccgtccggccctgcccccaggcagtccccgtcgacgccctcgccggcgctggcgaggaagaagagcgcgacgcccaagagtggagactgcgacggcgacgacgcgaggagcgtggtcagcactgtccggtccgagcggccccggaggcacagcatcggcgcgtccagcgtgcgtgacgacgcgggctcttccccgtcggtgccgagctacatggcggccaccaagtcggcgtcggccagggccaagtcgcgtgtgcagagcccgacgctgaccgagggtgctgctcaagctgagacgctggagaaaggatggtcttctgtgggttcagcgaagaagcggctgtcctttccggctgggacgccaccgccggtgccggcggcggcggcgaggcggcactccgggcctcccaaggtgcggcaggcgggcgtggaaggtggtacggaggaacgggactcgtcccttgcgtgacatcatgggaagcagattatggtgtggagcagagcagagcggaatttgttgcatttgttgagtgaaaggaacgcagaatgtgtgttgtgtggatccattggatttgatttgatttgtatgatggcagtattcctatttgattattcattgaataatataagtatctgtaatgaagataaaaggaggggacacgaacattatttc

SEQ ID NO: 360 - protein, 378 aa, Triticum aestivum
  misc_feature (1)..(378): Ceres Clone ID no. 826796
  misc_feature (6)..(24): Pfam Name: IQ Pfam Description: IQ calmodulin-binding motif
  misc_feature (1)..(378): Bit score of 903.8 for HMM based on sequences of Figure 1
  misc_feature (1)..(378): Functional Homolog Of SEQ ID NO. 353
  misc_feature (1)..(378): in Figure 1
MSRELAATKIQTAFRGHLARRALRALKGLVRLKSLVQGHSVKRQATSTLRCMQTLSRVQSKIRTRRIKMAEENQALQRQLLLNQELETLRMGDQWNTSLQSKEQIEASLVSRQEAAARRERALAYAFSHQWKSTSRSANPMFVDPSNPHWGWSWLERWMASRPFDGRNGASEKEGSSVDRTSVHSTSLSMNLGEGETVTKADNQVVDSLKPNDDKPPPLSTPKPSGPAPRQSPSTPSPALARKKSATPKSGDCDGDDARSVVSTVRSERPRRHSIGASSVRDDAGSSPSVPSYMAATKSASARAKSRVQSPTLTEGAAQAETLEKGWSSVGSAKKRLSFPAGTPPPVPAAAARRHSGPPKVRQAGVEGGTEERDSSLA

SEQ ID NO: 361 - DNA, 1470 bp, Populus trichocarpa
  misc_feature (1)..(1470): Ceres Annot ID no. 1465047
  misc_feature (1)..(1470): Encodes the peptide sequence at SEQ ID NO. 362
atggggaaaagagggagttggttctctgctttgaagaaagccctcggttcctctaagaaatccaaatcaaagaagaaatggtcagaaaaagagaagaaccgggatctaggtgtttcttcacatgaagaaaccgttgcaccctctctttctcctcctcgtacaccacctcctcctacagcagaagatgtgaaattaactgaagctgagaacgagcagagcaagcatgcttattccgtggcgcttgccactgctgtggcagctgaggcagctgttgcagccgcccaggctgccgctgaggttgttcggcttactacagtggcacattactctggaaaatcgaaggaggaaatagctgcaatcaggattcaaacagcatttagaggatacctggcgaggagggcattacgtgctttgagagggctggtgagattgaagtcattgatacaagggcaatctgtcaaacggcaagcaactgccacattacgagccatgcagactcttgctcgtgtgcagtctcagattcgtgcaagaaggatcagaatgtccgaggaaaatgaggccctccaacggcagctccagcagaaacatgacaaagaacttgagaagttgagaacttctattggagaacaatgggatgatagcccacaatcaaaggaagaagttgaagccagcctactacaaaagcaagaagctgccatgagaagagaaagggcactggcttatgcatactcgcatcagcaaatgtggaagcaatcttcaaaatcagcaaatgctacattcatggatccaaacaatcctcgttggggatggagttggttagagaggtggatggcagcccgaccttgggagagccgaagcacaatagataacaatgatcgggcctctgttaagagtacaacaagccgtaccatgtctcttggagaaatcagcagagcttattctcgtcgtgatcttaaccatgacaataaagcttctcctggtgcgcaaaaatcaagtcggcctcccagtcggcaatcaccttctactcccccctctaaggcaccatctacatcttcagtaacagggaaagcaaagccaccaagccctagagggagtgcttggggaggagacgaggactccaggagcacattcagtgtccagtctgagcgctatcggagacatagcatagcagggtcatcaataagagatgatgagagtcttgcaagttcgccttcagttccaagttacatggcacccacacggtcacagtcagcaaaggcaaaatcccgcttgtcaagcccgttaggcatagataataatgggacaccagataaggcatcagtgggttatgtaaagaagcggctttccttctctgcttcaccagctggagcaaggagacactctggtcctcctagggtggatgccagtgctgttaaagacattcaaatgcacagagaagagaaaatgagcaatggagcaagcagcaagtag

SEQ ID NO: 362 - protein, 326 aa, Populus trichocarpa
  misc_feature (1)..(326): Ceres Annot ID no. 1465047
  misc_feature (118)..(136): Pfam Name: IQ Pfam Description: IQ calmodulin-binding motif
  misc_feature (1)..(326): Bit score of 746.3 for HMM based on sequences of Figure 1
  misc_feature (1)..(326): Functional Homolog Of SEQ ID NO. 353
  misc_feature (1)..(326): in Figure 1
MQTLARVQSQIRARRIRMSEENEALQRQLQQKHDKELEKLRTSIGEQWDDSPQSKEEVEASLLQKQEAAMRRERALAYAYSHQQMWKQSSKSANATFMDPNNPRWGWSWLERWMAARPWESRSTIDNNDRASVKSTTSRTMSLGEISRAYSRRDLNHDNKASPGAQKSSRPPSRQSPSTPPSKAPSTSSVTGKAKPPSPRGSAWGGDEDSRSTFSVQSERYRRHSIAGSSIRDDESLASSPSVPSYMAPTRSQSAKAKSRLSSPLGIDNNGTPDKASVGYVKKRLSFSASPAGARRHSGPPRVDASAVKDIQMHREEKMSNGASSK

SEQ ID NO: 363 - DNA, 1876 bp, Gossypium hirsutum
  misc_feature (1)..(1876): Ceres Clone ID no. 1919901
  misc_feature (1)..(1876): Encodes the peptide sequence at SEQ ID NO. 364
aacttttcttagttatcctctgcaaatgccaacctgttcttttattattattttccgccatttttgctctctttcaagcattttttttttgcctagatccacttctctctctttgatttttaattactgcatttttgttttaatacacaataagaacaactaagagatagaatgtgacttatcaatcttttaactgagatctgtgagaatttttctatgtaccaaggaattatttacagatgggaaaaaaaggtggctggctttctattgtgaagaaagctttgagccctgaatccaagaaatctcagcaccaaactccaaagccaaagaaaaaatggttcggaaaaagcaaaaatttgagccctgtgtctgtgcctgaagaaactgaagtgataactgaagatgcaaagctaaaagaagctgaaaacgaacaaagcaaacatgcctactctgtggctcttgccaccgctgtggcggccgaggcagcggtggcagctgctcaggcggctgctgaagttgtccgtctcacttctcagccgcgccatctggggaagtcaaaggaggaaatagctgctatcaggattcaaacagcatttcgtggatatttggctaggagggcactgcgagctttgagagggttggtaaggttgaaatcgttgatcagagggcaatccgtcaaacgccaagcaactacaacgttaagatgcatgcagactctagctcgtctgcagtctgagatttctgcaaggaggattagaatgtcagaagagaaccaggctcttcagcgccagcttcaacagaaatgccagaaagagctcgagaagttgagagctcccatgagagaagactggaacgatagtacacagtcgaaggagcagatcgaagcaagacaacaaaataagcaaggagctactatgaaaagggaaagagcattggcttatgcatactgtcaccagcgatcgtggaagaactgttctagatcagtgaatcaaacatttatggatccgagtaattcacactggggttggagttggttagagcgatggatggcagcccgaccatgggaagtccaaagcacaactgataacaatgaccgtggctcagtcaagagtatgggtgcttgttcgatatctataagtgaaatcagcagagcttattctcgaagagatcttaacaatgataacaaaccatctccaacacctcagaagtcaagtcgagttcctagccgccagtctccatcgactccaccttcaaaggcaccttcgatttcatcggtttctggtaaaacaagactgccaagtccgagaggaagtcaatggggagggtatgaagactcaaggagcatactcagtacccggtctgatcgttataggagacatagcattgcagggtcctcaatgagagacgatgagagccttacaagctcacctgcagttccaagttatatggcaccaacacagtccacaaaggccaggtcccacataccaagccccttaggaagtggcacaccagataggagagtggcagggtctgcaaagaaacggcttttgttcccagcatccccagccagtagtaggagacattcagagcctcctaaagtggacataagtgaggctagaaagaatcagcatgcaccaagcaatggaaggcaagtggcttggtgaagagtgcaacaaaagttagattgaataaacatggaagggttatttcaacttgaagttcttgtagtgtggttgtgattatctttttcttcctaggttttatgattattaattataaaagggttacttttttctgggtgagatttagtttattgtttgtggttgacaaacattcttaaaaatcttcaagtttagtttcaattcatgaaatttgt

SEQ ID NO: 364 - protein, 474 aa, Gossypium hirsutum
  misc_feature (1)..(474): Ceres Clone ID no. 1919901
  misc_feature (111)..(129): Pfam Name: IQ Pfam Description: IQ calmodulin-binding motif
  misc_feature (1)..(474): Bit score of 1214.0 for HMM based on sequences of Figure 1
  misc_feature (1)..(474): Functional Homolog Of SEQ ID NO. 353
  misc_feature (1)..(474): in Figure 1
MGKKGGWLSIVKKALSPESKKSQHQTPKPKKKWFGKSKNLSPVSVPEETEVITEDAKLKEAENEQSKHAYSVALATAVAAEAAVAAAQAAAEVVRLTSQPRHLGKSKEEIAAIRIQTAFRGYLARRALRALRGLVRLKSLIRGQSVKRQATTTLRCMQTLARLQSEISARRIRMSEENQALQRQLQQKCQKELEKLRAPMREDWNDSTQSKEQIEARQQNKQGATMKRERALAYAYCHQRSWKNCSRSVNQTFMDPSNSHWGWSWLERWMAARPWEVQSTTDNNDRGSVKSMGACSISISEISRAYSRRDLNNDNKPSPTPQKSSRVPSRQSPSTPPSKAPSISSVSGKTRLPSPRGSQWGGYEDSRSILSTRSDRYRRHSIAGSSMRDDESLTSSPAVPSYMAPTQSTKARSHIPSPLGSGTPDRRVAGSAKKRLLFPASPASSRRHSEPPKVDISEARKNQHAPSNGRQVAW

SEQ ID NO: 365 - DNA, 1904 bp, Zea mays; identical to SEQ ID NO: 352
  misc_feature (1)..(1904): Ceres Seed Line no. ME02064
  misc_feature (1)..(1904): Encodes the peptide sequence at SEQ ID NO. 366

SEQ ID NO: 366 - protein, 311 aa, Zea mays
  misc_feature (1)..(311): Ceres Seed Line no. ME02064
  misc_feature (1)..(311): Bit score of 653.2 for HMM based on sequences of Figure 1
  misc_feature (1)..(311): Functional Homolog Of SEQ ID NO. 353
MTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 367 - DNA, 1332 bp, Glycine max
  misc_feature (1)..(1332): Ceres Clone ID no. 520008
  misc_feature (1)..(1332): Encodes the peptide sequence at SEQ ID NO. 368
atgcattcactcatcaggtttttttaaaaaaaaaaaattctcatcaatttacacatgcgagaaaatgggtgaaaaatttaatacgaactgaaaaatctttcaaaaatatcgcatattataaacactaaaatgagaaatcaagcatccttattatactatatggatatactcttcactgtttctttatctcttgaatctgttatactttccaactgagacttaggcctgattcctgataagtgcacgagtcctttcctatcttgtcactatcttcagagccatatcctctgcactctcctttctcactgccacgatgatcttttgcataatccaatgatatgctaatgctttgttaagtaagttgcagcgtaaattcttcctcaattttgtcaatggaagtattttgttactgaaataaagtggcatgctatattatgtaacatattttgaatgaatagcattctgcctatgatatgattttcaatcataagtgtaagttccttgatgctgtcaacaaattcagtgtttgatatttgggggcaaaaaatatttggcagcaaaactggaagaactcgtctagatctgtaaatccaatgtttatggatccaactaatccgagctggggttggagctggttggaacgatggatggcagcccgaccttgggagagccgtagccatatggataaagagttgaatgaccactcctccataagaagctcaagccgcagcattaccggtggagaaatcagcaagtcatttgctcgtttccagctcaattcggaaaagcactctccaacagccagccagaatcctggctcccctagctttcagtccactccttccaagccagcttcatcatctgctaagaaaccaaagaaggtaagtccaagcccaaggggcagctgggttatggacgaggactccaaaagcttggtcagtgtacactctgaccggttccggaggcactccattgccggttcatcggtgagagatgacgagagccttgctagctctccagcagttccaagctacatggtgccaactcaatctgcaaaagccaagtccaggacacaaagtccattagcctcagaaaatgcaaaagcagagaaaggttcctttgggagtgcaaagaagcggctttctttcccagcttcacctgccaggccaaggcgccattcaggtccaccaaaggttgaaagcagcagcttaaatgcagagttagctgtggacaagggtgtggacagttgatcatacaagtaaaaggatggaaaagcattaaagtaggattgaaaatatatcactgaagaaataaaacaaaaagagtttattt

SEQ ID NO: 368 - protein, 218 aa, Glycine max
  misc_feature (1)..(218): Ceres Clone ID no. 520008
  misc_feature (43)..(77): Pfam Name: IQ Pfam Description: IQ calmodulin-binding motif
  misc_feature (1)..(218): Bit score of 156.2 for HMM based on sequences of Figure 1
  misc_feature (1)..(218): Functional Homolog Of SEQ ID NO. 353
MFMDPTNPSWGWSWLERWMAARPWESRSHMDKELNDHSSIRSSSRSITGGEISKSFARFQLNSEKHSPTASQNPGSPSFQSTPSKPASSSAKKPKKVSPSPRGSWVMDEDSKSLVSVHSDRFRRHSIAGSSVRDDESLASSPAVPSYMVPTQSAKAKSRTQSPLASENAKAEKGSFGSAKKRLSFPASPARPRRHSGPPKVESSSLNAELAVDKGVDS

SEQ ID NO: 369 - protein, 445 aa, Arabidopsis thaliana
  misc_feature (1)..(445): Public GI ID no. 7413581
  misc_feature (115)..(134): Pfam Name: IQ Pfam Description: IQ calmodulin-binding motif
  misc_feature (1)..(445): Bit score of 1019.4 for HMM based on sequences of Figure 1
  misc_feature (1)..(445): Functional Homolog Of SEQ ID NO. 353
MGKKAKWFSSVKKAFSPDSKSKQKLAEGQNGVISNPPVVDNVRQSSSSPPPALAPREVRVAEVIVERNRDLSPPSTADAVNVTATDVPVVPSSSAPGVVRRATPTRFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYSYSHQQNWKNNSKSGNPMFMDPSNPTWVPRKNKSNSNNDNAASVKGSINRNEAAKSLTRNGSTQPNTPSSARGTPRNKNSFFSPPTPSRLNQSSRKSNDDDSKSTISVLSERNRRHSIAGSSVRDDESLAGSPALPSYMVPTKSARARLKPQSPLGGTTQENEGFTDKASAKKRLSYPTSPALPKPRRFSAPPKVESGGVTVTNGAGS

SEQ ID NO: 370 - DNA, 1806 bp, Zea mays
  misc_feature (1)..(1806): Ceres Clone ID no. 228069
  misc_feature (1)..(1806): Encodes the peptide sequence at SEQ ID NO. 371
gagccgcggaggagcagcggcgcatcgcaacactaaccaaagtcctcctctccaggtgccgagccagggtgactgttccgaggagcgtggcgtggacccatggggaagaagggcaagtggttcggtgccgtcaagaaggtcttcagccccgaatccaaggagaagaaagaggagaggctaaggaggaaatcagcagctagcaacccagcaccggtagatctgaccccatctacctccctggaagtcaatgtttcggtgccaccccctccggctcctcctccagttcctcgccagaccgacgaggtcagggtccccgaagccgagcaggagcagagcaagcatgtcaccctggaggaggcccctgctgctgctgctgccccagcacaggcgtcggtgctgccacctggtgcgccaaccgaagagctcgccgcaatcaagatccagaccgccttccgaggttacctggcaaggagggcactaagagcactacgaggccttgtacgattgaagtcattggttgagggtaattcagttaagcgtcaatctgcaagcactctgcgctgtatgcaaactctatcgcgggtgcagtcacaaatacgatctaggagagcaaagatgtccgaggagaaccaggccctccaacgccagctcctacttaaacaggaactggagaatttcagaatgggtgagaactgggacgacagcactcaatccaaggagcaaatcgaggcaagcctaataagcaggcaagaggcagcgataagaagagaaagagctcttgcatatgcattttcacatcagtggaagagcacatcaagatctgcgaacccaatgtttgtagacccaaataacttgcagtggggctggagctggttggagcgctggatggcagcaaaaccttgggagggacgcaatgggaccgacaaggagagcaacattgatcgcggctccgtcaagaatatgagcttgaaccttggagttggagagggtgagatcacaaaagctttcaaccgccgggactcaaagccagagaagccatcaccaccgactccaaaaccggcccgtccagcttccaggcaatccccttcgacgccctctgctagagtggccccaatacctgcgaggaggaaatccagcacgccaaagaatgggctttcacaggtggacgatgacgtgaggagcgtgctcagtgtgcagtctgagcgaccaaggaggcacagcatagccacgacgtcgaccatgcgggacgatgagagcctcgcgagctccccgtcgctcccgagctacatggttcccacagaatctgcgagggccaaatctcgcacagcaacggccaatggcgcagagacgcctgagaaaggaggctctgctggaccagtcaagaagaggttgtctttccaaggtggagctgcggctgcctcaccgatgcgacggcattctggccctcccaaggtggagagcgctgtgaaggacattgctgcgccaccacagcctgaggccttggtagccaatggtggtggaagcaagtgacttgtattgacaagttccaggatgggggagcgggttatggtcttatggagggacatgtttcatccgtgaacagaagttaagagtggtgccggatctacgaatggtttgaattgttttcccgttacaaccacattgtttgctgtataagattcactgtacctgccagttggttccatttgttgttttctgtaaaacaaacatcaatttgtcactagaatctgtgatgcttgtatgtaaacaggtcctctatttatgtgagccatatatttcattttc

SEQ ID NO: 371 - protein, 476 aa, Zea mays
  misc_feature (1)..(476): Ceres Clone ID no. 228069
  misc_feature (110)..(128): Pfam Name: IQ Pfam Description: IQ calmodulin-binding motif
  misc_feature (1)..(476): Bit score of 953.6 for HMM based on sequences of Figure 1
  misc_feature (1)..(476): Functional Homolog Of SEQ ID NO. 353
MGKKGKWFGAVKKVFSPESKEKKEERLRRKSAASNPAPVDLTPSTSLEVNVSVPPPPAPPPVPRQTDEVRVPEAEQEQSKHVTLEEAPAAAAAPAQASVLPPGAPTEELAAIKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSANPMFVDPNNLQWGWSWLERWMAAKPWEGRNGTDKESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 372 - DNA, 1703 bp, Glycine max
  misc_feature (1)..(1703): Ceres Clone ID no. 467508
  misc_feature (1)..(1703): Encodes the peptide sequence at SEQ ID NO. 373
aaaccatcctctcttagcatttggcaagatctgatttccctcttcacaaggagagaaatagaaaggcatatgatcttcttcaagttgcaatctttttagagagagagggttagaagaacaacatacttgagatctgtcactttgtttgagttcagatcttcaaagtttccttccttgttcttttggtgcaaaggatcaaattaaggaatgccaaatggggaggaaggggaattggttttccagtgtgatgaaagctctcagtcctgactcaaaggagaagaaagaacagaaatcaagtaaatctaagaagaaatggtttgggaagcaaaaattggagacttcagtctcatactcagaagctcataaagcaccaccaccaccgcgacctattcctccaccagaagcgattaaattaactgatattgaaaatgaaatcagtcatgatcacgactatgttgttgaagttgcaactgccatggatgccgaggaacctgttccttctgttcagatagaacctgttagggttgaagctgccccaattgctcattatgctggtaaaccaaaggatgaagtggcagctatcaaaattcaaacagcttttcgtggatacttggcaagaagagcattgcgggctttaagggggctggtcaggttgaaattattgatggaagggccagttgttaaacgccaagccacaagtaccctccactctatgcagacattatctcgcttgcagtctcagattcgttcaaggaggatcagaatgttagaggagaatcaggctctgcagagacagctcttacagaagcatgcaagagagcttgagagcttgcggatgggagaggaatgggatgacagcctacaatcaaaagaacaaatcgaagccaagttacttagcaagtatgaagctactacgagaagagaaagagcgctggcttatgcattcactcatcagcaaaattggaagaactcatctagatctgtaaatccaatgttcatggatccaaccaatccaagctggggttggagctggttggaacgatggatggcagcccgaccttgggagagccgtagccatatggataaagagttgaatgaccactcatccgtaagaagctcaagccgcagtattaccggtggagaaatcagcaagtcatttgctcgtttccagctcaatttggaaaagcactctccaacagcctgccagaatcctggctcacctagctttcagtccactccttccaagccagcttcaatatctgctaagaaaccaaagaaggtaagtccaagcccaaggggcagctgggttacagacgaggactccaaaagcttggtcagtgtacagtcagaccggttccggaggcactccattgccggttcattggtgagagatgatgagagccttgctagctctccagcagttccaagctacatggtgccaactcaatctgcaaaagccaagtccaggacacaaagtccattagccccagaaaatggaaaagcagagaaaggttcctttgggagtgcgaagaagcggctttctttcccagcttcacctgccaggccaaggcgccattcaggtccaccaaaggtagaaagcagcagcttaaatgcagagttagctgtggacaagggtgtggacagttgatcatacaagtaaaaggatggaaaaacattaaagtaggattgaaaatatatcactg

SEQ ID NO: 373 - protein, 477 aa, Glycine max
  misc_feature (1)..(477): Ceres Clone ID no. 467508
  misc_feature (121)..(139): Pfam Name: IQ Pfam Description: IQ calmodulin-binding motif
  misc_feature (1)..(477): Bit score of 852.6 for HMM based on sequences of Figure 1
  misc_feature (1)..(477): Functional Homolog Of SEQ ID NO. 353
MGRKGNWFSSVMKALSPDSKEKKEQKSSKSKKKWFGKQKLETSVSYSEAHKAPPPPRPIPPPEAIKLTDIENEISHDHDYVVEVATAMDAEEPVPSVQIEPVRVEAAPIAHYAGKPKDEVAAIKIQTAFRGYLARRALRALRGLVRLKLLMEGPVVKRQATSTLHSMQTLSRLQSQIRSRRIRMLEENQALQRQLLQKHARELESLRMGEEWDDSLQSKEQIEAKLLSKYEATTRRERALAYAFTHQQNWKNSSRSVNPMFMDPTNPSWGWSWLERWMAARPWESRSHMDKELNDHSSVRSSSRSITGGEISKSFARFQLNLEKHSPTACQNPGSPSFQSTPSKPASISAKKPKKVSPSPRGSWVTDEDSKSLVSVQSDRFRRHSIAGSLVRDDESLASSPAVPSYMVPTQSAKAKSRTQSPLAPENGKAEKGSFGSAKKRLSFPASPARPRRHSGPPKVESSSLNAELAVDKGVDS

SEQ ID NO: 374 - DNA, 1475 bp, Gossypium hirsutum
  misc_feature (1)..(1475): Ceres Clone ID no. 1829581
  misc_feature (1)..(1475): Encodes the peptide sequence at SEQ ID NO. 375
attattttcaatgcaatttaagagttttatttattttatgttataaattttttaacctctaaatatgatttgaaatgttaattccattggttgtttttggttttgaaggagaatttattgaggaatgggcaaaaaaggaagctggtttactgctgtgaagaaagttctaagccttgaacccaacaaagaagagaagattcaaaaatccaagaaaaatggggttaaattacctgagaagatcaaaggaagcaaacgtgacaactggttcgctccggccaccaccatggtgaccggcgcgttggttcgccttactttgtcgccacactacttgggaaaatcaatggaggaaatagctactgttaagattcaaactgtgtttcgaggatacctggcgaggaaggcattgcgagatttgagagggttagagaggttgaaatcattgatacaagggcaatccatgaaacgacaagccactattacgttacgatgcatgcggacacttgctcgagtgcagtcccaaactcgaacaaggcaactcagagtgtctgaacaaaaccgagcacttcaaaagcatcttcaaactaaatacgaaaaacagttgcaaaattccaaatcttacatgggagaagattggaatgtaagtactaagtctaaagagcaaatgcaagcaaaacaacaatatagacaagtagcagccatgcgaagggagagagctttagcttactcatttactcatcagcgatcctggaaggtcacttgtagatcgatgaatcacacatctatggatccatttaatcctaaatggagctggagttggttagagcgatggatgtcaactcgaccatgggagattcaaaatgcaccggataacaatgatcatggcccaagtaagagtgttggtgctgagataaccaaagctaagtctcaaagtgatgttaacaatgatcacaataaacaatcttcaacaccggcaaaaccgattcgacctccgaaccgtaggtcctcttcgactccaccgtctaaaacgcattctatttctagcaagaagggattggaaagccccagtccgacacgaattcagttgcctgattgttacaagaggcatagcatcggaggcttatcattggagagagacgatgaggtctttgcaaactcaccacctaataataaaataccggcacgttcgtcatcaaaggaccggtctcgaccaccgagcattaatagaaatccagttaatactaggagacattctggtcctccgaaagttgatattttttccaactaaggaagaaatgccaaacaatgacaaaggcaggtagtttatgaagcatagacactttagtcgcgagtgccggccacatgtttaatattgaaatggctccgacacaatcaaatgtgtgttggttatatgacgatatattttttcaaaaaatcaaatactatcagaaaaaaatataaagaaagattaattggat

SEQ ID NO: 375 - protein, 386 aa, Gossypium hirsutum
  misc_feature (1)..(386): Ceres Clone ID no. 1829581
  misc_feature (77)..(95): Pfam Name: IQ Pfam Description: IQ calmodulin-binding motif
  misc_feature (1)..(386): Bit score of 365.6 for HMM based on sequences of Figure 1
  misc_feature (1)..(386): Functional Homolog Of SEQ ID NO. 353
MGKKGSWFTAVKKVLSLEPNKEEKIQKSKKNGVKLPEKIKGSKRDNWFAPATTMVTGALVRLTLSPHYLGKSMEEIATVKIQTVFRGYLARKALRDLRGLERLKSLIQGQSMKRQATITLRCMRTLARVQSQTRTRQLRVSEQNRALQKHLQTKYEKQLQNSKSYMGEDWNVSTKSKEQMQAKQQYRQVAAMRRERALAYSFTHQRSWKVTCRSMNHTSMDPFNPKWSWSWLERWMSTRPWEIQNAPDNNDHGPSKSVGAEITKAKSQSDVNNDHNKQSSTPAKPIRPPNRRSSSTPPSKTHSISSKKGLESPSPTRIQLPDCYKRHSIGGLSLERDDEVFANSPPNNKIPARSSSKDRSRPPSINRNPVNTRRHSGPPKVDIFSN

SEQ ID NO: 376 - protein, 500 aa, Oryza sativa
  misc_feature (1)..(500): Public GI ID no. 125550655
  misc_feature (108)..(121): Pfam Name: IQ Pfam Description: IQ calmodulin-binding motif
  misc_feature (1)..(500): Oryza sativa Indica Group
  misc_feature (1)..(500): Bit score of 910.9 for HMM based on sequences of Figure 1
  misc_feature (1)..(500): Functional Homolog Of SEQ ID NO. 353
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQAAIKIQTAFRGYLLSENSSWLFISSAAFIYHCVGANITKARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMVPPSPMRRHSGPPKVEVVKDIAEPPQPEALVINGGSK

SEQ ID NO: 377 - protein, 430 aa, Arabidopsis thaliana
  misc_feature (1)..(430): Public GI ID no. 15231175
  misc_feature (110)..(128): Pfam Name: IQ Pfam Description: IQ calmodulin-binding motif
  misc_feature (1)..(430): Bit score of 594.7 for HMM based on sequences of Figure 1
  misc_feature (1)..(430): Functional Homolog Of SEQ ID NO. 353
MGKSWFSAVKKALSPEPKQKKEQKPHKSKKWFGKSKKLDVTNSGAAYSPRTVKDAKLKEIEEQQSRHAYSVAIATAAAAEAAVAAAQAAAEVVRLSALSRFPGKSMEEIAAIKIQTAFRGYMARRALRALRGLVRLKSLVQGKCVRRQATSTLQSMQTLARVQYQIRERRLRLSEDKQALTRQLQQKHNKDFDKTGENWNDSTLSREKVEANMLNKQVATMRREKALAYAFSHQNTWKNSTKMGSQTFMDPNNPHWGWSWLERWMAARPNENHSLTPDNAEKDSSARSVASRAMSEMIPRGKNLSPRGKTPNSRRGSSPRVRQVPSEDSNSIVSFQSEQPCNRRHSTCGSIPSTRDDESFTSSFSQSVPGYMAPTQAAKARARFSNLSPLSSEKTAKKRLSFSGSPKTVRRFSGPPKLESNVTKKDTNLA

SEQ ID NO: 378 - protein, 461 aa, Arabidopsis thaliana
  misc_feature (1)..(461): Public GI ID no. 145357576
  misc_feature (116)..(135): Pfam Name: IQ Pfam Description: IQ calmodulin-binding motif
  misc_feature (1)..(461): Bit score of 1117.5 for HMM based on sequences of Figure 1
  misc_feature (1)..(461): Functional Homolog Of SEQ ID NO. 353
MGKKAKWFSSVKKAFSPDSKKSKQKLAEGQNGVISNPPVVDNVRQSSSSPPPALAPREVRVAEVIVERNRDLSPPSTADAVNVTATDVPVVPSSSAPGVVRRATPTRFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYSYSHQQNWKNNSKSGNPMFMDPSNPTWGWSWLERWMAGRPLESSEKEQSNSNNDNAASVKGSINRNEAAKSLTRNGSTQPNTPSSARGTPRNKNSFFSPPTPSRLNQSSRKSNDDDSKSTISVLSERNRRHSIAGSSVRDDESLAGSPALPSYMVPTKSARARLKPQSPLGGTTQENEGFTDKASAKKRLSYPTSPALPKPRRFSAPPKVESGGVTVTNGAGS

SEQ ID NO: 379 - protein, 474 aa, Oryza sativa
  misc_feature (1)..(474): Public GI ID no. 125528277
  misc_feature (1)..(474): Oryza sativa Indica Group
  misc_feature (144)..(162): Pfam Name: IQ Pfam Description: IQ calmodulin-binding motif
  misc_feature (1)..(474): Bit score of 1169.6 for HMM based on sequences of Figure 1
  misc_feature (1)..(474): Functional Homolog Of SEQ ID NO. 353
MGKKGNWFSAVKKVFSSSDPDGREAKIEKADKSRSRRKWPFGKSKKSDPWTSTVAVPTSTAPPPQPPPPPPTHPIQPQPEEIKDVKAVETDSEQNKHAYSVALASAVAAEAAAVAAQAAAEVVRLTTATTAVPKSPVSSKDELAAIKIQTAFRGYLARRALRALRGLVRLKSLVDGNAVKRQTAHTLHCTQTMTRVQTQIYSRRVKMEEEKQALQRQLQLKHQRELEKMKIDEDWDHSHQSKEQWKNSGRTITPTFTDQGNPNWGWSWMERWMTSRPWESRVISDKDPKDHYSTKNPSTSASRTYVPRAISIQRPATPNKSSRPPSRQSPSTPPSRVPSVTGKIRPASPRDSWLYKEDDLRSITSIRSERPRRQSTGGASVRDDASLTSTPALPSYMQSTESARAKSRYRSLLTDRFEVPERVPLVHSSIKKRLSFPVADKPNGEHADKLMERGRRHSDPPKVDPASLKDVPVS

SEQ ID NO: 380 - protein, 495 aa, Zea mays
  misc_feature (1)..(495): Public GI ID no. 224032591
  misc_feature (136)..(154): Pfam Name: IQ Pfam Description: IQ calmodulin-binding motif
  misc_feature (1)..(495): Bit score of 1261.7 for HMM based on sequences of Figure 1
  misc_feature (1)..(495): Functional Homolog Of SEQ ID NO. 353
MGKRGKWFSAVKKVFSSSDPDGKEAKADKSKSKRRWPFGKSKHSEPSISTVPGTAPAVAPLPSPPATQPHSLEIKDVNPVETDSEQNKHAYSVALASAVAAEAAAVAAQAAAEVVRLTAVTTAAPKMPVSSREELAATKIQTAFRGYLARRALRALRGLVRLKSLVDGNAVKRQTAHTLQCTQAMTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 381 - DNA, 1497 bp, Sorghum bicolor
  misc_feature (1)..(1497): Ceres Annot ID no. 8669409
  misc_feature (1)..(1497): Encodes the peptide sequence at SEQ ID NO. 382
atgggtaagaaaggaaagtggtttagtgcggtgaagaaagtcttcagctcctctggtacagatggaaaggaagcaaaggctgagaaagcagacaagtcaaaatccaagaggagatggccattcggaaaaacgaagaagcactccgagccttcgatctcaacggtggcagggactgctccggtagctccgttgccatcaccaccaccaactcagccccactctctggagattaaagatgtcaatccacttgaaacagacagtgagcagaacaagcatgcctactctgttgcgcttgcatctgctgtcgctgctgaagctgcagcggttgctgcccaggctgctgcggaggttgtccgcctcacagcagttaccacggctgcaccaaaaatgcctgttagttcaatggaagaacttgctgccaccaagattcagactgccttcaggggttatctggcaaggagagcattgcgggcactaagagggctagttagattgaagtcgcttgttgatggaaatgctgtcaaacgccaaaccgctcacaccttgcaatgcacacaaacaatgacaagagttcaaactcaaatctattctagaagggtgaagttggaggaggagaaacaggctcttcaaaggcagctccaattgaaacatcaaagagaacttgagaaaatgaagattgatgaagactgggatcacagccatcaatccaaagagcaaattgaggccaaccttatgatgaaacaggaagctgcaatgagacgagaaagagcccttgcatatgcattttctcaccagtggaggacttctggtcgaactataacccctacttttacggaacctgggaaccctaactggggctggagctggatggaacgctggatgaccgctagaccttgggagagccgattggtggcatcagacaaggatcctaaagaacgtgctctgacaaagaatccaagcaccattactgttcaagccgcatctgtaccccgtgccatctcaatccagagaccagctacaccaaacaagtcaagccggccaccaagccggcagtcaccttcaactccaccatcgaaggccccatcaacctcaggaaagaccaggccagcaagtccaaggggcaattggctgtacaaggaggatgacctgaggagcatcacaagcatccgctctgagcgcccaaggaggcagagcacaggtggaggaggctcagtccgggatgatgcaagcctgacgagcacaccacctctccccagttacatgcaatcgacagagtctgcaagggcgaagtctcgataccgcagtctactgactgagaagcttgaggttcctgagagagcacctttggtccactctgttgttaagaagcgcctgtcgttccctgtcgtcgataagccaagtgttgtgccgacagataagccaaaggaaagagtgagacgccattcagatcctccgaaggtcgatcctgcaacactgaaggatgtccctgctgcttga

SEQ ID NO: 382 - protein, 498 aa, Sorghum bicolor
  misc_feature (1)..(498): Ceres Annot ID no. 8669409
  misc_feature (139)..(157): Pfam Name: IQ Pfam Description: IQ calmodulin-binding motif
  misc_feature (1)..(498): Bit score of 1210.7 for HMM based on sequences of Figure 1
  misc_feature (1)..(498): Functional Homolog Of SEQ ID NO. 353
MGKKGKWFSAVKKVFSSSGTDGKEAKAEKADKSKSKRRWPFGKTKKHSEPSISTVAGTAPVAPLPSPPPTQPHSLEIKDVNPLETDSEQNKHAYSVALASAVAAEAAAVAAQAAAEVVRLTAVTTAAPKMPVSSMEELAATKIQTAFRGYLARRALRALRGLVRLKSLVDGNAVKRQTAHTLQCTQTMTRVQTQIYSRRVKLEEEKQALQRQLQLKHQRELEKMKIDEDWDHSHQSKEQIEANLMMKQEAAMRRERALAYAFSHQWRTSGRTITPTFTEPGNPNWGWSWMERWMTARPWESRLVASDKDPKERALTKNPSTITVQAASVPRAISIQRPATPNKSSRPPSRQSPSTPPSKAPSTSGKTRPASPRGNWLYKEDDLRSITSIRSERPRRQSTGGGGSVRDDASLTSTPPLPSYMQSTESARAKSRYRSLLTEKLEVPERAPLVHSVVKKRLSFPVVDKPSVVPTDKPKERVRRHSDPPKVDPATLKDVPAA

SEQ ID NO: 383 - DNA, 1818 bp, Panicum virgatum
  misc_feature (1)..(1818): Ceres Clone ID no. 1901601
  misc_feature (1)..(1818): Encodes the peptide sequence at SEQ ID NO. 384
gaggaaaatgtcgggctgcttgcccttccttgccttttggcttgcagccgagacattgaagacacagtaatagaacacaaaagaatgggtaagaagggaaagtggtttagtgctgtgaagaaagtcttcggctcctccgatcctgatggaaagcaagcaaaggctgagaaggcggacaagtcaaaatccaggaggagatggccatttggaaagtcgaggcactctgatccttctgcctcaacggtgtcagggactgctccagtagctcctttgccgccgccgccaccaatacaacttactcagccacactctcaggagattaaagatgtcaagccagttgaaacagacagtgagcagaacaagcatgcatactctgttgcccttgcatctgctgttgctgctgaagctgcagcagttgctgcccaggccgctgctgaggttgtccgcctcacagcagttactacggcagcaccaaaaatgcctgttacttcaagggaagaacttgcggccatcaagattcagaccgccttcagaggttatctggcaaggagagcattgcgcgcactaagagggctagttagattgaagtcacttgttgatggacatgccgtcaagcgccaaactgctcatactttgcattgcacacaaacgatgacaagagttcaagctcaaatctactctagaagggtgaaattggaggaggaaaaacaggctcttcaaaggcagctccaattgaaacatcaaagggaacttgagaaaatgaagattgatgaagactgggatcacagccatcaatccaaagaacaaattgaggccagcctagttatgaaacaagaagctgcgctaagacgagaaagagcactcgcatatgctttttctcatcagtggagaaattctggtcgaactataaccccaactttcacagaacctggtaatcctaactggggctggagctggatggaacgctggatgacagcaagaccttgggagagccgattggcagcatcagacaaggatcctaaagagcgttctctgacaaagaattccagcaccagtgctgttcgaatgtctgtaccccgtgccatctcaatccagaggccagcaacaccaaacaagtcaagccgtccaccaagccggcaatcaccttcaacaccgccatcgaaggcaccatctacctcaggaaagaccaggccggcaagtccaaggagcagctggctgtacaaggaagatgacctgaggagcatcacaagcatacgctctgaacgcccaaggaggcagagcataggtggaggctcggtccgggatgatgcaagcctgactagcacaccacctctccccagttatatgcagtcgacagagtctgcgagagcaaagtctcgataccgcagcttattgactgagaaacttgagctttcagagagggcacctctggcccattcagttgttaagaagcgcctctccttcccagtcattgacaaaccgagcggtccaccggcagataagccaaaggaaagggtgagacgccattcagaccctccgaaagtcgatccggcaacactgaaggatgctcctgttgcctgatcaggcccttgtgattgttaggtttcatgctgttttaactccatgatgaaatttctaagattgttttctctgtgtaatgtatgatctgtccgggttgatttgagaattgagacaattctaactgtgtttgcagacatggttttctccctgtagattgacacgtgtgatgctaacagtgtgtgctgttggctttcaatgtaccatataacggtttttgacagactttcttaacgtgtg

SEQ ID NO: 384 - protein, 498 aa, Panicum virgatum
  misc_feature (1)..(498): Ceres Clone ID no. 1901601
  misc_feature (141)..(159): Pfam Name: IQ Pfam Description: IQ calmodulin-binding motif
  misc_feature (1)..(498): Bit score of 1196.3 for HMM based on sequences of Figure 1
  misc_feature (1)..(498): Functional Homolog Of SEQ ID NO. 353
MGKKGKWFSAVKKVFGSSDPDGKQAKAEKADKSKSRRRWPFGKSRHSDPSASTVSGTAPVAPLPPPPPIQLTQPHSQEIKDVKPVETDSEQNKHAYSVALASAVAAEAAAVAAQAAAEVVRLTAVTTAAPKMPVTSREELAAIKIQTAFRGYLARRALRALRGLVRLKSLVDGHAVKRQTAHTLHCTQTMTRVQAQIYSRRVKLEEEKQALQRQLQLKHQRELEKMKIDEDWDHSHQSKEQIEASLVMKQEAALRRERALAYAFSHQWRNSGRTITPTFTEPGNPNWGWSWMERWMTARPWESRLAASDKDPKERSLTKNSSTSAVRMSVPRAISIQRPATPNKSSRPPSRQSPSTPPSKAPSTSGKTRPASPRSSWLYKEDDLRSITSIRSERPRRQSIGGGSVRDDASLTSTPPLPSYMQSTESARAKSRYRSLLTEKLELSERAPLAHSVVKKRLSFPVIDKPSGPPADKPKERVRRHSDPPKVDPATLKDAPVA

SEQ ID NO: 385 - DNA, 2185 bp, Panicum virgatum
  misc_feature (1)..(2185): Ceres Clone ID no. 2034697
  misc_feature (1)..(2185): Encodes the peptide sequence at SEQ ID NO. 386
gggctcagggctttcggtggctgcctgcttgcttgcttgcttgctttagaggtggaagcttgcccttctcgcggtaaaatcggatcttttggggttttgcgcgccgctatttgattcttcttggctggcttcgcctgtggctttgttttgggggtttgctgggttggtttcttcgcgattgtggacgagggggtgcggtgggcagctgcgagagtttctctgggtctggggcaaatacactcttccggtctccctgtcgtttgcgattcgaccttctggtgagtttttgcgccagctaaacgatcgatggagttcaaatgtcgaagggtaggaagcgccacacgaagcttgcttgttgtgcaaaacaggcgcctttcttttgcttgcagccgagacattgaagacacagtaatagaacacaaaagaatgggtaagaagggaaagtggtttagtgctgtgaagaaagtcttcggctcctccgatccagatggaaagcaagcaaaggctgagaaggcggacaagtcaaaatccaggaggagatggccatttggaaagtcgaggcactctgatccttctgcctcaacggtgtcagggactgctccagtagctcctttgccgccgccgccaccaatacaacttactcagccacactctcaggagattaaagatgtcaagccagttgaaacagacagtgagcagaacaagcatgcatactctgttgcccttgcatctgctgttgctgctgaagctgcagcagttgctgcccaggccgctgctgaggttgtccgcctcacagcagttactacggcagcaccaaaaatgcctgttacttcaagggaagaacttgcggccatcaagattcagaccgccttcagaggttatctggcaaggagagcattgcgcgcactaagagggctagttagattgaagtcacttgttgatggacatgccgtcaagcgccaaactgctcatactttgcattgcacacaaacgatgacaagagttcaagctcaaatctactctagaagggtgaaattggaggaggaaaaacaggctcttcaaaggcagctccaattgaaacatcaaagggaacttgagaaaatgaagattgatgaagactgggatcacagccatcaatccaaagaacaaattgaggccagcctagttatgaaacaagaagctgcgctaagacgagaaagagcactcgcatatgcgttttctcatcagtggagaaattctggtcgaactataaccccaactttcacagaacctggtaatcctaactggggctggagctggatggaacgctggatgacagcaagaccttgggagagccgattggcagcatcagacaaggatcctaaagagcgttctctgacaaagaattccagcaccagtgctgttcgaatgtctgtaccccgtgccatctcaatccagaggccagcaacaccaaacaagtcaagccggccaccaagccggcaatcaccttcaacaccgccatcgaaggcaccatctacctcaggaaagaccaggccggcaagtccaaggagcagctggctgtacaaggaagatgacctgaggagcatcacaagcatacgctctgaacgcccaaggaggcagagcataggtggaggctcggtccgggatgatgcaagcctgactagcacaccacctctccccagttatatgcagtcgacagagtctgcgagagcaaagtctcgataccgcagcttattgactgagaaacttgagctttcagagagggcacctctggcccattcagttgttaataagcgcctctccttcccagtcattgacaaaccgagccgtccaccggcagataagccaaaggaaagggtgagacgccattcagaccctccgaaagtcgatccggcaacactgaaggatgctcctgttgcctgatcaggcccttgtgattgttaggtttcatgctgttttaactccatgatgaaatttctaagattgttttctctgtgtaatgtatgatctgtccgggttgatttgagaattgagacaattctaactgtgtttgcagacatggttttctccctgtagattgacacgtgtgatgctaacagtgtgtgctgttggctttcaatgtaccatataacggtttttgacagactttcttaacgtgtgaaaactgcaatatttagccattccg

SEQ ID NO: 386 - protein, 498 aa, Panicum virgatum
  misc_feature (1)..(498): Ceres Clone ID no. 2034697
  misc_feature (141)..(159): Pfam Name: IQ Pfam Description: IQ calmodulin-binding motif
  misc_feature (1)..(498): Bit score of 1185.6 for HMM based on sequences of Figure 1
  misc_feature (1)..(498): Functional Homolog Of SEQ ID NO. 353
MGKKGKWFSAVKKVFGSSDPDGKQAKAEKADKSKSRRRWPFGKSRHSDPSASTVSGTAPVAPLPPPPPIQLTQPHSQEIKDVKPVETDSEQNKHAYSVALASAVAAEAAAVAAQAAAEVVRLTAVTTAAPKMPVTSREELAAIKIQTAFRGYLARRALRALRGLVRLKSLVDGHAVKRQTAHTLHCTQTMTRVQAQIYSRRVKLEEEKQALQRQLQLKHQRELEKMKIDEDWDHSHQSKEQIEASLVMKQEAALRRERALAYAFSHQWRNSGRTITPTFTEPGNPNWGWSWMERWMTARPWESRLAASDKDPKERSLTKNSSTSAVRMSVPRAISIQRPATPNKSSRPPSRQSPSTPPSKAPSTSGKTRPASPRSSWLYKEDDLRSITSIRSERPRRQSIGGGSVRDDASLTSTPPLPSYMQSTESARAKSRYRSLLTEKLELSERAPLAHSVVNKRLSFPVIDKPSRPPADKPKERVRRHSDPPKVDPATLKDAPVA

SEQ ID NO: 387 - DNA, 1812 bp, Panicum virgatum
  misc_feature (1)..(1812): Ceres Clone ID no. 1747444
  misc_feature (1)..(1812): Encodes the peptide sequence at SEQ ID NO. 388
agaggtccgtgcggtgggcggtggcttaccagagttaggtccttggcgccttcagtcgggtgaggaaggcttgcagccgagacattgaagacacagtaatagaacacaaaagaatgggtaagaagggaaagtggtttagtgctgtgaagaaagtcttcggctcctccgatcctgatggaaagcaagcaaaggctgagaaggcggacaagtcaaaatccagtaggagatggccatttggaaagtcgaggcactctgatccttctgcctcaacggtgtcagggactgctccagtagctcctttgccgccgccgccaccaatacaacttactcagccacactctcaggagattaaagatgtcaagccagttgaaacagacagtgagcagaacaagcatgcatactctgttgcccttgcatctgctgttgctgctgaagctgcagcagttgctgcccaggccgctgctgaggttgtccgcctcacagcagttactacggcagcaccaaaaatgcctgttacttcaagggaagaacttgcggccatcaagattcagaccgccttcagaggttatctggcaaggagagcattgcgcgcactaagagggctagttagattgaagtcacttgttgatggacatgccgtcaagcgccaaactgctcatactttgcattgcacacaaacgatgacaagagttcaagctcaaatctactctagaagggtgaaattggaggaggaaaaacaggctcttcaaaggcagctccaattgaaacatcaaagggaacttaagaaaatgaagattgatgaagactgggatcacagccatcaatccaaagaacaaattgaggccagcctagttatgaaacaagaagctgcgctaagacgagaaagagcactcgcatatgctttttctcatcagtggagaaattctggtcgaactataaccccaactttcacagaacctggtaatcctaactggggctggagctggatggaacgctggatgacagcaagaccttgggagagccgattggcagcatcagacaaggatcctaaagagcgttctctgacaaagaattccagcaccagtgctgttcgaatgtctgtaccccgtgccatctcaatccagaggccagcaacaccaaacaagtcaagccgtccaccaagccggcaatcaccttcaacaccgccatcgaaggcaccatctacctcaggaaagaccaggccggcaagtccaaggagcagctggctgtacaaggaagatgacctgaggagcatcacaagcatacgctctgaacgcccaaggaggcaaagcataggtggaggctcggtccgggatgatgcaagcctgactagcacaccacctctccccagttatatgcagtcgacagagtctgcgagagcaaagtctcgataccgcagcttattgactgagaaacttgagctttcagagagggcacctctggcccattcagttgttaagaagcgcctctccttcccagtcattgacaaaccgagcggtccaccggcagataagccaaaggaaagggtgagacgccattcagaccctccgaaagtcgatccggcaacactgaaggatgctcctgttgcctgatcaggcccttgtgattgttaggtttcatgctgttttaactccatgatgaaatttctaagattgttttctctgtgtaatgtatgatctgtccgggttgatttgagaattgagacaattctaactgtgtttgcagacatggttttctccctgtagattgacacgtgtgatgctaacagtgtgtgctgttggctttcaatgtacc

SEQ ID NO: 388 - protein, 498 aa, Panicum virgatum
  misc_feature (1)..(498): Ceres Clone ID no. 1747444
  misc_feature (141)..(159): Pfam Name: IQ Pfam Description: IQ calmodulin-binding motif
  misc_feature (1)..(498): Bit score of 1187.9 for HMM based on sequences of Figure 1
  misc_feature (1)..(498): Functional Homolog Of SEQ ID NO. 353
MGKKGKWFSAVKKVFGSSDPDGKQAKAEKADKSKSSRRWPFGKSRHSDPSASTVSGTAPVAPLPPPPPIQLTQPHSQEIKDVKPVETDSEQNKHAYSVALASAVAAEAAAVAAQAAAEVVRLTAVTTAAPKMPVTSREELAAIKIQTAFRGYLARRALRALRGLVRLKSLVDGHAVKRQTAHTLHCTQTMTRVQAQIYSRRVKLEEEKQALQRQLQLKHQRELKKMKIDEDWDHSHQSKEQIEASLVMKQEAALRRERALAYAFSHQWRNSGRTITPTFTEPGNPNWGWSWMERWMTARPWESRLAASDKDPKERSLTKNSSTSAVRMSVPRAISIQRPATPNKSSRPPSRQSPSTPPSKAPSTSGKTRPASPRSSWLYKEDDLRSITSIRSERPRRQSIGGGSVRDDASLTSTPPLPSYMQSTESARAKSRYRSLLTEKLELSERAPLAHSVVKKRLSFPVIDKPSGPPADKPKERVRRHSDPPKVDPATLKDAPVA

SEQ ID NO: 389 - DNA, 2087 bp, Panicum virgatum
  misc_feature (1)..(2087): Ceres Clone ID no. 1998974
  misc_feature (1)..(2087): Encodes the peptide sequence at SEQ ID NO. 390
ggcaccgggagcgtgaccgtcacgagggggcgaagccccggggaagagccggagaggagatcgagagcggcccatcgcccccacaccacgccccacctccggctgcccgcctcccccgccgccgtggtccgcggctgcgggcggggccacgcgcccggctgggggtgaacagcgcgggacggggtcaccgtcgggcggtggggtgggcgaatcgatcctgcgtgcggggttgggctggccgataaaagggggcgcctttggactggcgaggcttgccgccgagacattgaagacacagtaatagaacacaaaaaatgggtaaaaagggaaagtggtttagtgctgtcaagaaagtcttcggctcctctgatccagatggaaaggaagcaaaggttgagaaggcggataagtcaaaatccaggaggagatggccatttggaaagtcgaggcactctgatccttctacctcaatggtgtcagggactgctccagtagctccgttgcctccgccaccaccaatacaacttactcagccacactcccaggagattaaagatgtcaagccagttgaaacagacagtgagcagaacaagcatgcatactctgttgcccttgcatccgctgttgctgctgaagctgctgcagttgctgcccaggccgctgctgaggttgtgcgcctcacagcagttaccacggcagcaccaaaaatgcctgttacttcaagggaagaacttgccgccatcaagattcagactgccttcaggggttatctggcaaggagagcattgcgggcactaagagggctagttagattgaagtcacttgtcgatggaaatgctgtcaagcgccaaacttctcacactttgcattgcacacaaacgatgacaagagttcaaactcaaatctactctagaagggtgaagttggaggaggaaaaacaagctcttcaaaggcagctccaattgaaacatcaaagggaacttgagaaaatgaagattgaagaagactgggatcacagccatcaatccaaagaacaaattgaggccagcctagttatgaaacaagaagctgcactaaaacgagaaagagcacttgcatatgcattttctcaccagtggagaaattctggtcgaactataaccccaactttcacagaacctgggaatcctaactggggctggagctggatggaacgctggatgacagcaagaccttgggagagccgattggcagcatcagacaaggataataaagagcgttctctgacaaagaattccagcagcagtgctgttcgaatgtctgtaccccgtgccatctcaatccagaggccagcaacaccaaacaagtcaagccgtccaccaagccggcagtcaccttcaacaccgccatcgaaggcaccatctacctcaggaaagaccaggccggcaagtccaaggggcagctggctgtacaaggaagatgacctgaggagcatcacaagcatacgctctgaacgcccaaggaggcaaagcataggcggaggctcggtccgggatgatgcaagcctgactagcacaccacctctccccagttatatgcagtcgacagagtctgcgagggcaaagtctcgataccgcagcttgttgactgaaaagcttgaggtttcagagagggcacctctggcccattcggttgttaagaagcgcctctccttccctgtcatcgacaaaccgagcagtccaccggcagataagacaaaggaaagagcgaggcgccattcagaccctccgaaggttgatcctgcaatgatgaaggatgcccctgttgcctgatcaggcccttgtgattgttaggtttcgtgctgttttaactccatgatgtattttctaagttagattgttttctctgcgtaatgtctaatctgtccgggttgatttgagaattgaggcaattctaactgtatttgctgtcatggttttctccctgtagattgatacgtgtgattctaatagtgtatgcccttggctttcaatgtacgatataacggtttttgacagactttcttaacgtgcgaaattgcaatatatatatatatatatatccattcc

SEQ ID NO: 390 - protein, 498 aa, Panicum virgatum
  misc_feature (1)..(498): Ceres Clone ID no. 1998974
  misc_feature (141)..(159): Pfam Name: IQ Pfam Description: IQ calmodulin-binding motif
  misc_feature (1)..(498): Bit score of 1188.9 for HMM based on sequences of Figure 1
  misc_feature (1)..(498): Functional Homolog Of SEQ ID NO. 353
MGKKGKWFSAVKKVFGSSDPDGKEAKVEKADKSKSRRRWPFGKSRHSDPSTSMVSGTAPVAPLPPPPPIQLTQPHSQEIKDVKPVETDSEQNKHAYSVALASAVAAEAAAVAAQAAAEVVRLTAVTTAAPKMPVTSREELAAIKIQTAFRGYLARRALRALRGLVRLKSLVDGNAVKRQTSHTLHCTQTMTRVQTQIYSRRVKLEEEKQALQRQLQLKHQRELEKMKIEEDWDHSHQSKEQIEASLVMKQEAALKRERALAYAFSHQWRNSGRTITPTFTEPGNPNWGWSWMERWMTARPWESRLAASDKDNKERSLTKNSSSSAVRMSVPRAISIQRPATPNKSSRPPSRQSPSTPPSKAPSTSGKTRPASPRGSWLYKEDDLRSITSIRSERPRRQSIGGGSVRDDASLTSTPPLPSYMQSTESARAKSRYRSLLTEKLEVSERAPLAHSVVKKRLSFPVIDKPSSPPADKTKERARRHSDPPKVDPAMMKDAPVA

SEQ ID NO: 391 - DNA, 2233 bp, Panicum virgatum
  misc_feature (1)..(2233): Ceres Clone ID no. 1883040
  misc_feature (1)..(2233): Encodes the peptide sequence at SEQ ID NO. 392
gagaaaaaaggttgggctgcttgcccttcctttgctttttggtactttctttccgtctccggtttatttttccttcgtcctggatgcgctggtcgcgggtttgatctgaccaagacgtagaggcggtggtagaggtccgtggggtgggcggtggcttgctagagttaggtccttggcgcattcaggcgggtgaggaaggtgaggggctcagggctttcggtggttgcttgcttgcttgcttgctttgcctttctcgcggtaaaatcggatcttttggggttttgcgcgccgctatttgattcttcttggctggcttcgcctgcgcctttgttttggggttttgctgggttggtttcttcgcgattgtggtcgagggcggtgcggcgggtgcctcaggcacagctgcgagggtttctctgggtctggggcaacatccactcttcccgtttgtgattcgaccttctggcttgccgccgagacattgaagacacagtaatagaacacaaaaaatgggtaaaaagggaaagtggtttagtgctgtcaagaaagtcttcggctcctctgatccagatggaaaggaagcaaaggttgagaaggcggataagtcaaaatccaggaggagatggccatttggaaagtcgaggcactctgatccttctacctcaatggtgtcagggactgctccagtagctccgttgcctccgccaccaccaatacaacttactcagccacactcccaggagattaaagatgtcaagccagttgaaacagacagtgagcagaacaagcatgcatactctgttgcccttgcatccgctgttgctgctgaagctgatgcagttgctgcccaggccgctgctgaggttgtgcgcctcacagcagttaccacggcagcaccaaaaatgcctgtaacttcaagggaagaacttgccgccatcaagattcagactgccttcaggggttatctggcaaggagagcattgcgggcactaagagggctagttagattgaagtcacttgtcgatggaaatgctgtcaagcgccaaacttctcacactttgcattgcacacaaacgatgacaagagttcaaactcaaatctactctagaagggtgaagttggaggaggaaaaacaagctcttcaaaggcagctccaattgaaacatcaaagggaacttgagaaaatgaagattgaagaagactgggatcacagccatcaatccaaagaacaaattgaggccagcctagttatgaaacaagaagctgcactaaaacgagaaagagcacttgcatatgcattttctcaccagtggagaaattctggtcgaactataaccccaactttcacagaacctgggaatcctaactggggctggagctggatggaacgctggatgacagcaagaccttgggagagccgattggcagcatcagacaaggataataaagagcgttctctgacaaagaattccagcagcagtgctgttcgaatgtctgtaccccgtgccatctcaatccagaggccagcaacaccaaacaagtcaagccgtccaccaagccggcagtcaccttcaacaccgccatcgaaggcaccatctacctcaggaaagaccaggccagcaagtccaaggggcagctggctgtacaaggaagatgacctgaggagcatcacaagcatacgctctgaacgcccaaggaggcaaagcataggcggaggctcggtccgggatgatgcaagcctgactagcacaccacctctccccagttatatgcagtcgacagagtctgcgagggcaaagtctcgataccgcagcttgttgactgaaaagcttgaggtttcagagagggcacctctggcccattcggttgttaagaagcgcctctccttccctgtcatcgacaaaccgagcagtccaccggcagataagacaaaggaaagagcgaggcgccattcagaccctccgaaggttgatcctgcaatgctgaaggatgcccctgttgcctgatcaggcccttgtgattgttaggtttcgtgctgttttaactccatgatgtattttctatgttagattgttttctctgcgtaatgtctaatctgtccgggttgatttgagaattgaggcaattctaactgtatttgctgtcatggttttctccctgtagattgatacgtgtgattctaatagtgtatgcccttggctttcaatgtacgatataacggtttttgacagac

SEQ ID NO: 392 - protein, 498 aa, Panicum virgatum
  misc_feature (1)..(498): Ceres Clone ID no. 1883040
  misc_feature (141)..(159): Pfam Name: IQ Pfam Description: IQ calmodulin-binding motif
  misc_feature (1)..(498): Bit score of 1186.4 for HMM based on sequences of Figure 1
  misc_feature (1)..(498): Functional Homolog Of SEQ ID NO. 353
MGKKGKWFSAVKKVFGSSDPDGKEAKVEKADKSKSRRRWPFGKSRHSDPSTSMVSGTAPVAPLPPPPPIQLTQPHSQEIKDVKPVETDSEQNKHAYSVALASAVAAEADAVAAQAAAEVVRLTAVTTAAPKMPVTSREELAAIKIQTAFRGYLARRALRALRGLVRLKSLVDGNAVKRQTSHTLHCTQTMTRVQTQIYSRRVKLEEEKQALQRQLQLKHQRELEKMKIEEDWDHSHQSKEQIEASLVMKQEAALKRERALAYAFSHQWRNSGRTITPTFTEPGNPNWGWSWMERWMTARPWESRLAASDKDNKERSLTKNSSSSAVRMSVPRAISIQRPATPNKSSRPPSRQSPSTPPSKAPSTSGKTRPASPRGSWLYKEDDLRSITSIRSERPRRQSIGGGSVRDDASLTSTPPLPSYMQSTESARAKSRYRSLLTEKLEVSERAPLAHSVVKKRLSFPVIDKPSSPPADKTKERARRHSDPPKVDPAMLKDAPVA

SEQ ID NO: 393 - protein, 499 aa, Hordeum vulgare
  misc_feature (1)..(499): Public GI ID no. 326520123
  misc_feature (1)..(499): Hordeum vulgare subsp. vulgare
  misc_feature (144)..(162): Pfam Name: IQ Pfam Description: IQ calmodulin-binding motif
  misc_feature (1)..(499): Bit score of 1134.3 for HMM based on sequences of Figure 1
  misc_feature (1)..(499): Functional Homolog Of SEQ ID NO. 353
MAKKGKWFSAVRRVFSSSDPEGKEAKTEKADKPKSRRKWPFGKSKRFDPPTSTVSDITPVAPSPLPLPLPPTQPPQPQPEEIKDVKPVETESEQNKHAYSVALASAVAAEAAAVAAQAAAEVVRLTAVPTATSRAPVCSQEELAAVKIQTAFRGYLARRALRALRGLVRLKSLVDGNAVKRQTAHTLHCTQTMARVQTQIYSRRVKMEEEKQALQRQLQLKHQRELEKMKIDEDWDHSHQSKEQIEASLIMKQEAAVRRERALAYAFSHQWKNSGRTVTPTFTDQGNPNWGWSWMERWMSARPWENRVVSNKDKDTALTKNPSTNAARTFVPRALSIQRPATPSKSSRPPSRQSPSTPPSKNPSVAGKFRPSSPRDSWLYREDDLRSITNIRSERPRRLSTGGGSIQDDASLTSTPALPSYMQSTKSARAKSRYHMVFADKFEVPDRASLVHSSIKKRLSFPAAEKPNVTPADKLKERARRHSDPPKVEPASLKDVHVA

SEQ ID NO: 394 - DNA, 1190 bp, Zea mays
  misc_feature (1)..(1190): Ceres Clone ID no. 101697218
  misc_feature (1)..(1190): Encodes the peptide sequence at SEQ ID NO. 395
taagagggctagttagattgaagtcgcttgttgatggaaatgctgtcaaacgccaaaccgctcacaccttgcaatgcacacaagcaatgacaagagttcaaactcaaatctactctagaagggtgaagttggaggaggagaaacaggctcttcaaagacaactccaattgaaacatcaaagggaacttgagaaaatgaagattgatgaagattgggatcacagccatcaatccaaagagcaaattgaggccaacctaatgatgaaacaggaagctgcactcaggcgagaaagagcacttgcatatgcattttctcaccagtggaggaattctggtcgaactataacccctacttttacggaacctgggaaccccaactggggctggagctggatggagcgctggatgacagcaagaccatgggagagccggttggcggcggcatcggacaaggaccctaaagaacgtgctgtgacaaagaatgcgagcaccagtgctgttcgagcacctgtatcccgtgccatctcgattcagagaccagcaacaccaaacaagtcgagccgcccaccaagccggcagtcactttcaaccccgccatcgaagaccccgtcagcctcaggaaaggccaggccggcaagtccaaggaacagttggctgtacaaggaggatgacctgaggagcatcacgagcatccgctccgagcgcccaaggaggcagagcacgggtggaggctcggtccgggacgataccagcctgaccagcacaccacctctccccagctacatgcagtcgaccgagtctgcacgggccaagtctcggtaccgcagtctactactgactgagaagcttgaggttcctgagagagcgcctctggcccactccgttgtcaagaagcgcctgtcgttccccgtcgtcgagaagccaagcgttgtgccgacagagaagcccagggaaagagtgaggcgccattccgaccctccgaaggtcgatcctgcgacgctcaaggatgcccctgctgcctgaccagtgaccaggccttatgtgattgttaggtttcgtgctcttttaacaccgtgatgtattatctgagttaggttgctttgttcgtgtcatcgtatgatctgtccgggttgattttgagacagttctaactgtgtttacagacaatgcgtgatgctaaatgtatgtgtg

SEQ ID NO: 395 - protein, 311 aa, Zea mays
  misc_feature (1)..(311): Ceres Clone ID no. 101697218
  misc_feature (135)..(156): Pfam Name: IQ Pfam Description: IQ calmodulin-binding motif
  misc_feature (1)..(311): Bit score of 651.0 for HMM based on sequences of Figure 1
  misc_feature (1)..(311): Functional Homolog Of SEQ ID NO. 353
MTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRAPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 396 - protein, 308 aa, Oryza sativa
  misc_feature (1)..(308): Public GI ID no. 215701453
  misc_feature (144)..(162): Pfam Name: IQ Pfam Description: IQ calmodulin-binding motif
  misc_feature (1)..(308): Oryza sativa Japonica Group
  misc_feature (1)..(308): Bit score of 658.9 for HMM based on sequences of Figure 1
  misc_feature (1)..(308): Functional Homolog Of SEQ ID NO. 353
MTRVQTQIYSRRVKMEEEKQALQRQLQLKHQRELEKMKIDEDWDHSHQSKEQVETSLMMKQEAALRRERALAYAFSHQWKNSGRTITPTFTDQGNPNWGWSWMERWMTSRPWESRVISDKDPKDHYSTKNPSTSASRTYVPRAISIQRPATPNKSSRPPSRQSPSTPPSRVPSVTGKIRPASPRDSWLYKEDDLRSITSIRSERPRRQSTGGASVRDDASLTSTPALPSYMQSTESARAKSRYRSLLTDRFEVPERVPLVHSSIKKRLSFPVADKPNGEHADKLMERGRRHSDPPKVDPASLKDVPVS

SEQ ID NO: 397 - protein, 482 aa, Vitis vinifera
  misc_feature (1)..(482): Public GI ID no. 225449126
  misc_feature (119)..(137): Pfam Name: IQ Pfam Description: IQ calmodulin-binding motif
  misc_feature (1)..(482): Bit score of 1122.5 for HMM based on sequences of Figure 1
  misc_feature (1)..(482): Functional Homolog Of SEQ ID NO. 353
MGKKGNWFSAVKKALSPEPKEKKDKTTPKSKKKWFGKHKNLDPVSSSTENAMPLPAPAPPIEDVKLTEAENEQSKHAYSVALATAVAAEAAVAAAHAAAEVVRLTTVTRFSGKSKEEVAAIKIQTAFRGYLARRALRALRGLVRLKSLIQGQSVKRQATTTLRCMQTLARVQSQIRARRIRMSEENLALQRQLQLKRDKELEKLRASMGDDWDDSVQSKEQIEANLQSKQEAAVRRERALAYAFSHQQTWKNSSKPANPTFMDPNNPHWGWSWLERWMAARPWESRSAMEKELNTDHASLKSTTSRAFSIGEISKAYARRDLNLDKKPSPTAQKPSRPPSRQSPSTPPSKAQSSSSVTGKTKPASPKGSGWGADDDSRSMLSIQSERYRRHSIAGSLVRDDESLASSPAVPSYMASTESTRARSRLPSPLGLEKNGTPEKASGSSAKKRLSFPASPAGPRRHSGPPRVETSSIKAISPAHRG

SEQ ID NO: 398 - protein, 482 aa, Vitis vinifera
  misc_feature (1)..(482): Public GI ID no. 147809623
  misc_feature (119)..(137): Pfam Name: IQ Pfam Description: IQ calmodulin-binding motif
  misc_feature (1)..(482): Bit score of 1113.8 for HMM based on sequences of Figure 1
  misc_feature (1)..(482): Functional Homolog Of SEQ ID NO. 353
MGKKGNWFSAVKKALSPEPKEKKDKTTPKSKKKWFGKHKNLDPVSSSTENAMPLPAPAPPIEDVKLTEAENEQSKHAYSVALATAVAAEAAVAAAHAAAEVVRLTTVTRFSGKSKEEVAAIKIQTAFRGYLARRALRALRGLVRLKSLIQGQSVKRQATTTLRCMQTLARVQSQIRARRIRMSEENLALQRQLQLKRDKELEKLRASIGDDWDDSVQSKEQIEANLQSKQEAAVRRERALAYAFSHQQTWKNSSKPANPTFMDPNNPHWGWSWLERWMAARPWESRSAMEKELNTDHASLKSTTSRAFSIGEISKAYARRDLNLDKKPSPTAQKPSRPPSRQSPSTPPSKAQSSSSVTGKTRPASPKGSGWGADDDSRSMLSIQSEWYRRHSIAGSLVRDDESLASSPAVPSYMASTESTRARSRLPSPLGLEKNGTPEKASGSSAKKRLSFPASPAGPRRHSGPPRVETSSIKAISPAHRG

SEQ ID NO: 399 - protein, 443 aa, Populus trichocarpa
  misc_feature (1)..(443): Public GI ID no. 224109704
  misc_feature (113)..(131): Pfam Name: IQ Pfam Description: IQ calmodulin-binding motif
  misc_feature (1)..(443): Bit score of 997.8 for HMM based on sequences of Figure 1
  misc_feature (1)..(443): Functional Homolog Of SEQ ID NO. 353
MGKRGSWFSALKKALGSSKKKWSEKEKNRDLGVSSHEETVAPSLSPPRTPPPPTAEDVKLTEAENEQSKHAYSVALATAVAAEAAVAAAQAAAEVVRLTTVAHYSGKSKEEIAAIRIQTAFRGYLARRALRALRGLVRLKSLIQGQSVKRQATATLRAMQTLARVQSQIRARRIRMSEENEALQRQLQQKHDKELEKLRTSVKQWDDSPQSKEEVEASLLQKQEAAMRRERALAYAYSHQQMWKQSSKSANATFMDPNNPRWGWSWLERWMAARPWESRSTIDNNDRASVKSTTSPSPGAQKSSRPPSRQSPSTPPSKAPSTSSVTGKAKPPSPRGSAWGGDEDSRSTFSVQSERYRRHSIAGSSIRDDESLASSPSVPSYMAPTRSQSAKAKSRLSSPLGIDNNGTPDKASVGYVKKRLSFSASPAGARRHSGPPRVDASAV

SEQ ID NO: 400 - protein, 479 aa, Vitis vinifera
  misc_feature (1)..(479): Public GI ID no. 225439898
  misc_feature (113)..(132): Pfam Name: IQ Pfam Description: IQ calmodulin-binding motif
  misc_feature (1)..(479): Bit score of 949.3 for HMM based on sequences of Figure 1
  misc_feature (1)..(479): Functional Homolog Of SEQ ID NO. 353
MGRKGNWLSSVKKALSPEPKEKKDQRADKSKKKWFGKHKYPDPNPSSLETVPGPSLAPPEEVKTIEPDNEHHKHVYSVAATTTMASLDVPETDVEVVEITTLTQSTGKAKEEAAAIKIQTAFRGYLARRALRALRGLVRLQSLIQGTAVKRQAANTLRCMQTLARVQSQICYRRIRMSEENQALQRQLLQKQAKEFEQLKMGEEWDDSLQSKEQIEAGLLNKQGAAMRRERALAYAFSHQQAWKNSSKSTNLLFMDPSNPHWGWSWLERWMAARPWESRSTTDKELNNDQLSIKSGSRSITGGEITKAYARHLLDSSKPSPTASQKPYHPPARQSPSTPPSKAVSSSSAAGKFKPAASPRGNLWGQDDDTKSMVSIQSERFRRHSIAGSSVGDDESLASSPAVPSYMAPTKSAKAKSRLQSPLGLENNGTPEKGSSGIAKKRLSFPASPARPRRHSGPPRVESSSLTEGIVSNGGGTVS

SEQ ID NO: 401 - protein, 474 aa, Oryza sativa
  misc_feature (1)..(474): Public GI ID no. 218196002
  misc_feature (1)..(474): Oryza sativa Indica Group
  misc_feature (108)..(127): Pfam Name: IQ Pfam Description: IQ calmodulin-binding motif
  misc_feature (1)..(474): Bit score of 944.4 for HMM based on sequences of Figure 1
  misc_feature (1)..(474): Functional Homolog Of SEQ ID NO. 353
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQAAIKIQTAFRGYLARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMVPPSPMRRHSGPPKVEVVKDIAEPPQPEALVINGGSK

SEQ ID NO: 402 - protein, 474 aa, Oryza sativa
  misc_feature (1)..(474): Public GI ID no. 54306075
  misc_feature (1)..(474): Oryza sativa Japonica Group
  misc_feature (108)..(127): Pfam Name: IQ Pfam Description: IQ calmodulin-binding motif
  misc_feature (1)..(474): Bit score of 943.9 for HMM based on sequences of Figure 1
  misc_feature (1)..(474): Functional Homolog Of SEQ ID NO. 353
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQATIKIQTAFRGYLARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMAPPSPMRRHSGPPKVEVVKDIAEPPQPEALVINGGSK

SEQ ID NO: 403 - DNA, 1440 bp, Populus trichocarpa
  misc_feature (1)..(1440): Ceres Annot ID no. 1484880
  misc_feature (1)..(1440): Encodes the peptide sequence at SEQ ID NO. 404
atggggaggaaaggaaaatggttttctagtgtaaagaaagctcttagccctgattccaaggagaagaaagaccagaaatcaaataaatcgaagaagaaatggtttggcaagcaacaactggattcggattccacttctttagaaaatgttacaatgcgatctcctcctcctcctcaaccagacgaggtgaaattaattgaaaccacaaatgaagagaaccagcatacttactctgttccagttgtcactgctgcagtagctgagcatgctccgattactgttcaaaccaccactgaggtttttcaaccaaccaaggttaataaatatgctggcaaatcaaaggaagaagtggcggcaattaagattcagacagcattccgaggatacatggcaagaagagcattgcgggctctgagagggctgttcaggctcaaatctctgatggaagggcctacgataaaaagacaagcaacccatactctccactgcatgcagactctagctcgggtgcagtcacagatacacacaaggaggattagaatgtcagaagagaaccaggccctacagagacaactcctacatgagcatgcaaaagagtttgaaagcttgcagattggagaggaatgggatgacagtctacagtcaaaggaacagattgaagctaacctgctaaacaagtttgaggcagctgtgagaagggaaagagcactggcttattctttctctcatcagcaagcctggaaaatttcttcacgagctgtaaacccaatgttcatgagtggcaatccatcctggggttggagctggttggaacgatggatggcagcccatccatgggagagccggagcatgacggagaaagaacttaataatgaccactcatctctaaagagtgcgagccgcagcattactggaggggatataagcaaatcttatgctcgctaccagctcaattctgataaactaactccaagagaaagtgaaaggccaaccaaaaccgcgaacctacagttccaatcaactcctaacaagccagctgcttctacagttgctagaaaattgaagtcagccagcccaaggagtggcattgggggcctagatgatgaatctaaaagtgtggtcagtgttcagtcagatcatagtagaaggcatagcattgcaggttcatttgtacgagatgatgagagccttggaagctctccaccacttccaagttacatggtacctacagaatccgcgagagcaaagtccagattacaaaacccattgggggcagagatgaacggagcgcctgaaaaggaaaagggatccttggggtctgccaagaagcggctttcctaccctccctcaccagccaaagcaaggaggtattcaggtcccccgaaattggaaagcagcttaaaagcagaaaacagtgaggctgctggcgagggcatttaa

SEQ ID NO: 404 - protein, 479 aa, Populus trichocarpa
  misc_feature (1)..(479): Ceres Annot ID no. 1484880
  misc_feature (118)..(136): Pfam Name: IQ Pfam Description: IQ calmodulin-binding motif
  misc_feature (1)..(479): Bit score of 817.3 for HMM based on sequences of Figure 1
  misc_feature (1)..(479): Functional Homolog Of SEQ ID NO. 353
MGRKGKWFSSVKKALSPDSKEKKDQKSNKSKKKWFGKQQLDSDSTSLENVTMRSPPPPQPDEVKLIETTNEENQHTYSVPVVTAAVAEHAPITVQTTTEVFQPTKVNKYAGKSKEEVAAIKIQTAFRGYMARRALRALRGLFRLKSLMEGPTIKRQATHTLHCMQTLARVQSQIHTRRIRMSEENQALQRQLLHEHAKEFESLQIGEEWDDSLQSKEQIEANLLNKFEAAVRRERALAYSFSHQQAWKISSRAVNPMFMSGNPSWGWSWLERWMAAHPWESRSMTEKELNNDHSSLKSASRSITGGDISKSYARYQLNSDKLTPRESERPTKTANLQFQSTPNKPAASTVARKLKSASPRSGIGGLDDESKSVVSVQSDHSRRHSIAGSFVRDDESLGSSPPLPSYMVPTESARAKSRLQNPLGAEMNGAPEKEKGSLGSAKKRLSYPPSPAKARRYSGPPKLESSLKAENSEAAGEGI

SEQ ID NO: 405 - protein, 467 aa, Zea mays
  misc_feature (1)..(467): Public GI ID no. 224028605
  misc_feature (108)..(126): Pfam Name: IQ Pfam Description: IQ calmodulin-binding motif
  misc_feature (1)..(467): Bit score of 1000.9 for HMM based on sequences of Figure 1
  misc_feature (1)..(467): Functional Homolog Of SEQ ID NO. 353
MGKKGKWFGAVKKVFSPESKEKKEERLRRKSAASNPTPVDLTPSTSLEVNLSVPPPPAPPPVLHQAEEVGVPEAEQEQSKHVAVEEAPAAAPAQASVLPPAVPTQELAAVKIQTAFRGYLARRALRALRGLVRLKSLVEGNSVKRQSASTLRCMQTLSRVQSQISSRRAKMSEENQALQRQLLLKQELENFRIGENWDDSTQSKEQIEASLISRQEAAIRRERALAYAFSHQWKSTSRSVNPMFVDPNNLQWGWSWLERWMAAKPWEGRNGADKESNIDRGSVKSMSLNLGEGEITKAFNRRDSKLEKPSPPTPRPARPTSRHSPLTPSARVAPIPARRKFVTPKNGLSQVDDDARSVLSVQSERPRRHSIATSTVRDDESLTSSPSLPSYMVPTESARAKSRLQGSATANGAETPEKGGSTGPAKKRLSFQGGTVSASPMRRHSGPPKVEIAPPQPEALVVNGGSK

SEQ ID NO: 406 - DNA, 1437 bp, Populus trichocarpa
  misc_feature (1)..(1437): Ceres Annot ID no. 1528800
  misc_feature (1)..(1437): Encodes the peptide sequence at SEQ ID NO. 407
atggggaggaaaggaaaatggttttctagtgtaaagaaagctcttagccctgatcccaaggagaagacagaccagaaatcaaataaatcaaagaagaaatggtttggaaagcaacaactggattcggattccacttctttagaaaatgtcacaatgctgtctcctcctccccaaccagaagaagtgaaattaattgagacaacagatgaagtgaaccagcatactttccctgttccagttgccactgctgcagtacctgagcctgctccgactactgtccaaaccaatattgaggttgttcaactgaccaaggtaaacaaatatgctggcaaatcaaaggaagaagaggcggcaattaagattcaaacaacattcagaggatacatggccagaagagcattgcgggctctgagagggttggcgaggctcaaatttctgatggaagggcctagaataaaaaggcaagcaacacataccctccgctgcatgcagactctagctcgggtgcagtcacagattcacacaaggaggatcagaatgtcagaagagaaccaggccctacagagacaactcctacagaagcatgccaaagagcttgaaaacttgcggattggagaggaatgggatgacagtctacagtcgaaggaacagattgaagctagcctgctaaacaagtttgaggccgctacgagaagggaaagagcactggcttatgctttctctcatcagcaaactttgaagaattcttcacgatctgcaaaccccatgttcatgaatgggaatccttcctggggttggagctggttggaacgatggatggcagcccatccatgggagagccggagcttgatggagaaagaacacaataacgaccactcatctgtaaagagtgccagccgcagcattactggaggagaaataagcaaatcttatgctcgctaccagctcaattctgataaattaactccaagagaaagtgaaaggccaaccaaaaccacgaacctacagtccccatcaactcctaaaaagccagctgcttctacagttgctagaaaattgaagtcagcaagcccaaggagtaacattgggggcattgaagatgactctagaagcatggtcagtgttcaatcagatcgtagtagaaggcatagcattgctggttcatttgtgcgagatgatgagagcctcggaagctctccagcgcttccaagttacatggtacctacacaatctgcaagagcaaagtccagaatacatagcctattgggagcagaaaaggacgggacaccagaaaaggaaaagggttcctctgggcatacaaagaaacggctttcataccctccatcgccagccaaaggaaggaggtattctggccccccaaagttggaaagcagcttcaatgcaagaaatagcgtggctgctggcgagggaatttaa

SEQ ID NO: 407 - protein, 478 aa, Populus trichocarpa
  misc_feature (1)..(478): Ceres Annot ID no. 1528800
  misc_feature (116)..(135): Pfam Name: IQ Pfam Description: IQ calmodulin-binding motif
  misc_feature (1)..(478): Bit score of 835.8 for HMM based on sequences of Figure 1
  misc_feature (1)..(478): Functional Homolog Of SEQ ID NO. 353
MGRKGKWFSSVKKALSPDPKEKTDQKSNKSKKKWFGKQQLDSDSTSLENVTMLSPPPQPEEVKLIETTDEVNQHTFPVPVATAAVPEPAPTTVQTNIEVVQLTKVNKYAGKSKEEEAAIKIQTTFRGYMARRALRALRGLARLKFLMEGPRIKRQATHTLRCMQTLARVQSQIHTRRIRMSEENQALQRQLLQKHAKELENLRIGEEWDDSLQSKEQIEASLLNKFEAATRRERALAYAFSHQQTLKNSSRSANPMFMNGNPSWGWSWLERWMAAHPWESRSLMEKEHNNDHSSVKSASRSITGGEISKSYARYQLNSDKLTPRESERPTKTTNLQSPSTPKKPAASTVARKLKSASPRSNIGGIEDDSRSMVSVQSDRSRRHSIAGSFVRDDESLGSSPALPSYMVPTQSARAKSRIHSLLGAEKDGTPEKEKGSSGHTKKRLSYPPSPAKGRRYSGPPKLESSFNARNSVAAGEGI

SEQ ID NO: 408 - DNA, 2001 bp, Panicum virgatum
  misc_feature (1)..(2001): Ceres Clone ID no. 1792902
  misc_feature (1)..(2001): Encodes the peptide sequence at SEQ ID NO. 409
gtcactctcggcactgctcccagctgttgcgacctccgaacatccaaggctcctgcacccctgtcagtcctagctccagccaaaaatcgttggctcccgctgcctgctcctccgccttgcacctcccatgaccttccacgcgacatgattgcattgcaggcccctgcggagctcagctgtcctcccacgccgctgacgccttcttgttgcctccacgctgctgcgctcaaccgaaagggccttcctctctttgcttccgcggaaggatttggcgatttattcatctactaaagttgcatctctcttgtgcgtggtgattgtttcgaggagcgtggagcggagccatggggaagaagggcaagtggttcggcgcggtcaagaaagtgttcagccctgaatccaaggagaagaaggaggagaggcagaggaggaaatcagcagctagcaaccctactccactagatctgaccccgtcgacctccttggaagtcaatgtttcggtgccaccccctccagctcctccggctcttcaccagattaaggaggtcaggatccctgaagctgagcaggagcagagcaagcacatcaccgtagaggaggcccctgctgcccctgcacaggcgtcggtgcttccacctggtgtgccaagtgaagagcttgctgcaatcaagatccagactgccttccgaggttacctggcaaggagggcactgcgagcgctgcggggccttgttcgattgaagtcattggttgagggtgattcagttaggcgtcaatctgcaagcactctgcgctgtatgcagactctatcgcgggtgcagtcacaaatacgttctaggagagcaaagatgtctgaggagaaccaggccctccagcgccagctcctactgaagcaggaactggagaatttcaggatgggtgagaactgggatgacagcactcaatccaaagagcaaatcgaggcgagcctaataagcaggcaagaggcagcgattagaagagaaagagcgcttgcatatgcattttcacatcagtggaagagcacgtcgaggtctgtcaacccaatgtttgtagacccaaacaacttgcagtggggctggagctggctggagcgctggatggctgcaaaaccttgggagggccgcaatgggactgataaggagagcaatgttgaccgtggatccgttaagagcatgagcttgaaccttggagagggtgagatcactaaagctttcaaccgccgggactcaaagccagaaaagccatccccgccaactccaaaactgacccgtccagcctccaggcaatccccttcaacgccctccgctaaagtagcgccaatacctgtgaggagaaaatccgtcacgccaaagaatgggctttcacatgtggatgacgatgcgagaagtgtgttcagtgtgcagtctgagcgaccaaggaggcacagtatagccacctcgactgtgcgggacgatgagagtctcgcaagctccccatcactcccaagttatatggttcccacagaatctgcaagggcgaagtctcgtctccagggatcagcattgaataatggtgcagagacaccagagaaaggaagctctgctggaccggtcaagaaaaggttgtcctttcaaggtggaacagcggctgcctcaccaatgcgacggcattctggtcctcccaaggtggggagtgcggtgaaggatattgttgccccaccacagccagaggccttggtgatcaatggtggaagcaagtgactcatgacaagtaccaggagggtaaagcggacaatgaatatatattttatccatgaagaaaggttaacgtgatatcagctctatgagtgatttgaattgttttccagttacgaccacattgtttgctctataagattcacagtacctgccagttgattccattcgttgtttctgtaaaacaagtaccggttcgtcactagaatcagtgatgtttgtatgtaaacaggtcttctatttatgt

SEQ ID NO: 409 - protein, 471 aa, Panicum virgatum
  misc_feature (1)..(471): Ceres Clone ID no. 1792902
  misc_feature (106)..(124): Pfam Name: IQ Pfam Description: IQ calmodulin-binding motif
  misc_feature (1)..(471): Bit score of 962.5 for HMM based on sequences of Figure 1
  misc_feature (1)..(471): Functional Homolog Of SEQ ID NO. 353
MGKKGKWFGAVKKVFSPESKEKKEERQRRKSAASNPTPLDLTPSTSLEVNVSVPPPPAPPALHQIKEVRIPEAEQEQSKHITVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGTDKESNVDRGSVKSMSLNLGEGEITKAFNRRDSKPEKPSPPTPKLTRPASRQSPSTPSAKVAPIPVRRKSVTPKNGLSHVDDDARSVFSVQSERPRRHSIATSTVRDDESLASSPSLPSYMVPTESARAKSRLQGSALNNGAETPEKGSSAGPVKKRLSFQGGTAAASPMRRHSGPPKVGSAVKDIVAPPQPEALVINGGSK

SEQ ID NO: 410 - DNA, 2117 bp, Panicum virgatum
  misc_feature (1)..(2117): Ceres Clone ID no. 1806867
  misc_feature (1)..(2117): Encodes the peptide sequence at SEQ ID NO. 411
gtcactctcgccactgctcccagctgttgcgacttgcgacctccgatcatccaaggctcctgcacccctgtcagtcctagctccagccaaaaatcgttggcttccgctgcctgctcctccgccttgcacctcccatgaccttccacgcgacatgattgcattgcaggcccctgcggagctcagtgtcctcccacgccgctgacgccttcttgttgcctccccgctgctgcgcacaaccgaaagggccttcctctcttcctttgcttccgcggaaagatttggcgatttgttcatctactaaagttgcatctctcttgtgcgtgtttgccaccgtggtcttgttatcatcgtccaacgttgggtcgtctgatagatatagatctgggccatctggtgatttgcttgttcctcttcagggtgattgtttcgaggagtgtggagtggagccatggggaagaagggcaagtggttcggcgcggtcaagaaagtgttcagccctgaatccaaggagaagaaggaggagaggcagaggaggaaatcagcagctagcaaccctactccacgagatctgaccccgtcgacctccttggaagtcaatgtttcggtgccaccccctccagctcctccggcccttcaccagattgaggaaatcagggcccctgaagctgagcaggagcagagcaagcacgtcaccgtagaggaggctcctgctgcccctgcacaggcgtcggtgctgccacctggtgtgccaagtgaagagcttgctgcaatcaagattcagactgccttccgaggttacctggcaaggagggcactgcgagcgctgcggggccttgttcgattgaaatcattggttgagggtgattcagttaggcgtcaatctgcaagcactcttcgctgtatgcagactctatcgcgggtgcagtcacaaatacgttctaggagagcaaagatgtctgaggagaaccaggcccttcagcgccagctcctactgaagcaggaactggagaatttcaggatgggtgagaactgggatgacagcactcaatccaaagagcaaatcgaggcaagcctaataagcaggcaagaggcagcgattagaagagaaagagcgcttgcatatgcattttcacatcagtggaagagcacttcgagatctgtcaacccaatgtttgtagacccaaacaacttgcagtggggctggagctggttggagcgctggatggctgcaaaaccttgggagggctgcaatggggctgataaggagagcaacattgaccgtggatctgttaagagcatgagcttgaaccttggagagggtgagatcacaaaagctttcaaccgccgggactcaaagccagaaaagccatcaccgccaactccaaaactgacccgtccagcctccaggcaatccccttcgacgccctctgctaaagtagcgccaatacctgctaggagaaaatccgccacgccaaagaatgggctttcacatgtggatgacgatgcgagaagtgtgttcagcgtgcagtctgagcgaccaaggaggcacagtatagccacctcgactgtgcaggacaatgagagtctcgcaagctccccatcactcccaagttacatggttcccacagaatctgcaagggcgaagtctcgtctccagggatcagcattgactaatggtgcagagacaccggagaaaggaagctctgctggaccggtcaagaaaaggttgtcatttcaaggtggaacagcggctgcctcaccaatgcgacggcattctggtcctcccaaggtggacagtgtgatgaaggatattgttgccccaccacagccagaggccttggtgatcaatggtggaagcaagtgactcataccaggaggggaaagcggattatgaatatatattttatcgatgaagaaaggttaacgtgatatcagctcaatgagtgatttgaattgttttcttacgaccacattgtttgctctataagattcgcagtacctgccagttgattccattcgttgtttctgtaaaacaagtatcggttcgtcactagaatcaatgaagtttgtatgtaaacaggtcttctatttatgtgagccatatatttcttcttccg

SEQ ID NO: 411 - protein, 471 aa, Panicum virgatum
  misc_feature (1)..(471): Ceres Clone ID no. 1806867
  misc_feature (106)..(124): Pfam Name: IQ Pfam Description: IQ calmodulin-binding motif
  misc_feature (1)..(471): Bit score of 961.1 for HMM based on sequences of Figure 1
  misc_feature (1)..(471): Functional Homolog Of SEQ ID NO. 353
MGKKGKWFGAVKKVFSPESKEKKEERQRRKSAASNPTPRDLTPSTSLEVNVSVPPPPAPPALHQIEEIRAPEAEQEQSKHVTVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGCNGADKESNIDRGSVKSMSLNLGEGEITKAFNRRDSKPEKPSPPTPKLTRPASRQSPSTPSAKVAPIPARRKSATPKNGLSHVDDDARSVFSVQSERPRRHSIATSTVQDNESLASSPSLPSYMVPTESARAKSRLQGSALTNGAETPEKGSSAGPVKKRLSFQGGTAAASPMRRHSGPPKVDSVMKDIVAPPQPEALVINGGSK

SEQ ID NO: 412 - DNA, 2024 bp, Panicum virgatum
  misc_feature (1)..(2024): Ceres Clone ID no. 1727738
  misc_feature (1)..(2024): Encodes the peptide sequence at SEQ ID NO. 413
gttctctctccctcgtcactctcgccactgctcccagctgttgcgacctccgatcatccaaggctcctgcacccctgtcagtcctagctccagccaaaaatcgttggcttccgctgcctgctcctccgccttgcacctcccatgaccttccacgcgacatgattgcattgcaggcccctgcggagctcagtgtcctcccacgccgctgacgccttcttgttgcctccccgctgctgcgcacaaccgaaagggccttcctctcttcctttgcttccgcggaaagatttggcgatttgttcatctactaaagttgcatctctcttggtgattgtttcgaggagtgtggagtggagccatggggaagaagggcaagtggttcggcgcggtcaagaaagtgttcagccctgaatccaaggagaagaaggaggagaggcagaggaggaaatcagcagctagcaaccctactccacgagatctgaccccgtcgacctccttggaagtcaatgtttcggtgccaccccctccagctcctccggcccttcaccagattgaggaaatcagggcccctgaagctgagcaggagcagagcaagcacgtcaccgtagaggaggctcctgctgcccctgcacaggcgtcggtgctgccacctggtgtgccaagtgaagagcttgctgcaatcaagattcagactgccttccgaggttacctggcaaggagggcactgcgagcgctgcggggccttgttcgattgaaatcattggttgagggtgattcagttaggcgtcaatctgcaagcactcttcgctgtatgcagactctatcgcgggtgcagtcacaaatacgttctaggagagcaaagatgtctgaggagaaccaggcccttcagcgccagctcctactgaagcaggaactggagaatttcaggatgggtgagaactgggatgacagcactcaatccaaagagcaaatcgaggcaagcctaataagcaggcaagaggcagcgattagaagagaaagagcgcttgcatatgcattttcacatcagtggaagagcacttcgagatctgtcaacccaatgtttgtagacccaaacaacttgcagtggggctggagctggttggagcgctggatggctgcaaaaccttgggagggctgcaatggggctgataaggagagcaacattgaccgtggatctgttaagagcatgagcttgaaccttggagagggtgagatcacaaaagctttcaaccgccgggactcaaagccagaaaagccatcaccgccaactccaaaactaacccgtccagcctccaggcaatccccttcgacgccctctgctaaagtagcgccaatacctgctaggagaaaatccgccacgccagagaatgggctttcacatgtggatgacgatgcgagaagtgtgttcagcgtgcagtctgagcgaccaaggaggcacagtatagccacctcgactgtgcaggacaatgagagtctcgcaagctccccatcactcccaagttacatggttcccacagaatctgcaagggcgaagtctcgtctccagggatcagcattgactaatggtgcagagacaccagagaaaggaagctctgctggaccggtcaagaaaaggttgtcatttcaaggtggaacagcggctgcctcaccaatgcgacggcattctggtcctcccaaggtggacagtgcggtgaaggatattgttgccccaccacagccagaggccttggtgatcaatggtggaagcaagtgactcataccaggaggggaaagcggattatgaatatatattttatcgatgaagaaaggttaacgtgatatcagctcaatgagtgatttgaattgttttcttacgaccacattgtttgctctataagattcgcagtacctgccagttgattccattcgttgtttctgtaaaacaagtatcggttcgtcactagaatcaatgaagtttgtatgtaaacaggtcttctatttatgtgagccatatatttcttcttctg

SEQ ID NO: 413 - protein, 471 aa, Panicum virgatum
  misc_feature (1)..(471): Ceres Clone ID no. 1727738
  misc_feature (106)..(124): Pfam Name: IQ Pfam Description: IQ calmodulin-binding motif
  misc_feature (1)..(471): Bit score of 957.3 for HMM based on sequences of Figure 1
  misc_feature (1)..(471): Functional Homolog Of SEQ ID NO. 353
MGKKGKWFGAVKKVFSPESKEKKEERQRRKSAASNPTPRDLTPSTSLEVNVSVPPPPAPPALHQIEEIRAPEAEQEQSKHVTVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGCNGADKESNIDRGSVKSMSLNLGEGEITKAFNRRDSKPEKPSPPTPKLTRPASRQSPSTPSAKVAPIPARRKSATPENGLSHVDDDARSVFSVQSERPRRHSIATSTVQDNESLASSPSLPSYMVPTESARAKSRLQGSALTNGAETPEKGSSAGPVKKRLSFQGGTAAASPMRRHSGPPKVDSAVKDIVAPPQPEALVINGGSK

SEQ ID NO: 414 - protein, 467 aa, Zea mays
  misc_feature (1)..(467): Public GI ID no. 238007500
  misc_feature (108)..(126): Pfam Name: IQ Pfam Description: IQ calmodulin-binding motif
  misc_feature (1)..(467): Bit score of 1001.0 for HMM based on sequences of Figure 1
  misc_feature (1)..(467): Functional Homolog Of SEQ ID NO. 353
MGKKGKWFGAVKKVFSPESKEKKEERLRRKSAASNPTPVDLTPSTSLEVNLSVPPPPAPPPVLHQAEEVGVPEAEQEQSKHVAVEEAPAAAPAQASVLPPAVPTQELAAVKIQTAFRGYLARRALRALRGLVRLKSLVEGNSVKRQSASTLRCMQTLSRVQSQISSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGADKESNIDRGSVKSMSLNLGEGEITKAFNRRDSKLEKPSPPTPRPARPTSRHSPLTPSARVAPIPARRKFVTPKNGLSQVDDDARSVLSVQSERPRRHSIATSTVRDDESLTSSPSLPSYMVPTESARAKSRLQGSATANGAETPEKGGSTGPAKKRLSFQGGTVSASPMRRHSGPPKVEIAPPQPEALVVNGGSK

SEQ ID NO: 415 - DNA, 1422 bp, Sorghum bicolor
  misc_feature (1)..(1422): Ceres Annot ID no. 8724651
  misc_feature (1)..(1422): Encodes the peptide sequence at SEQ ID NO. 416
atggggaagaagggcaagtggttcggcgccgtcaagaaggtcttcagccctgaatccaaggagaagaaagaggagagactaaggaggaaatcagcagctagcaacccagcaccgctagatctgaccccatctacctccttggaagtcaatgtttcggtgccaccccctccagctccggcacctcctccagttctccaccaggccgaggaggtcagggtccctgaacccgagcaggagcagagcaagcatgtcaccgtggaggagccccctgctgttccagcacagccgtcggtgctgccacctggtgtgccaaccgaagagcttgctgcggtcaagatccagaccgccttccgaggttacctggcaaggagggcactaagagcactgcgaggtcttgttcgattgaagtcattggttgagggtaattcagtcaagcgtcaatctgcaagcactctgcgctgtatgcaaactctatcgcgggtgcagtcacaaatacgttctaggagagcaaagatgtccgaggagaaccaggccctccaacgccagctcctacttaaacaggaattggagaatttcagaatgggtgagaactgggatgacagcactcaatccaaggagcaaatcgaggcaagcctgataagcaggcaagaagcagcgataagaagagaaagagcgcttgcatatgcattttcacatcagtggaagagtacttcaagatctgtcaacccaatgtttgtagacccaaacaacttgcagtggggctggagctggttggagcgctggatggcagcaaaaccttgggagggccgtaatggggctgacaaggagagcaactttgaccgcggatcagttaagagtatgagcttgaaccttggagagggtgaaatcacaaaagctttcaaccgccgggactcaaagccagaaaagccatcaccaccaactccaaaaccaacccgtccagcctggcaatccccttcgacgccatctgctaaagtggcaccaatacctgccaggaggaaatccgccacgccaaagaatgggctttcacaggtggacgatgacgctaggagtgtgctcagcgtgcagtctgagcgaccaaggaggcacagtatagccacctcgactgtgcgggatgatgaaagcctcgcaagctccccatcactccccagctacatggttcccacggaatctgcaagagccaaatctcgtctccagggctcatcaatgaccaatggtgcagagacaccagagaaaggaggctctactggaccagtcaagaagaggttgtccttccaaggtggaactgcagctgcctcaccaatgcggcggcattctggtcctcccaaggtggagagtgcagtgaaggacattgttgcaccaccacagccagaggccttggtagtcaatggtggaagcaagtga

SEQ ID NO: 416 - protein, 473 aa, Sorghum bicolor
  misc_feature (1)..(473): Ceres Annot ID no. 8724651
  misc_feature (109)..(127): Pfam Name: IQ Pfam Description: IQ calmodulin-binding motif
  misc_feature (1)..(473): Bit score of 957.1 for HMM based on sequences of Figure 1
  misc_feature (1)..(473): Functional Homolog Of SEQ ID NO. 353
MGKKGKWFGAVKKVFSPESKEKKEERLRRKSAASNPAPLDLTPSTSLEVNVSVPPPPAPAPPPVLHQAEEVRVPEPEQEQSKHVTVEEPPAVPAQPSVLPPGVPTEELAAVKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGADKESNFDRGSVKSMSLNLGEGEITKAFNRRDSKPEKPSPPTPKPTRPAWQSPSTPSAKVAPIPARRKSATPKNGLSQVDDDARSVLSVQSERPRRHSIATSTVRDDESLASSPSLPSYMVPTESARAKSRLQGSSMTNGAETPEKGGSTGPVKKRLSFQGGTAAASPMRRHSGPPKVESAVKDIVAPPQPEALVVNGGSK

SEQ ID NO: 417 - DNA, 1836 bp, Panicum virgatum
  misc_feature (1)..(1836): Ceres Clone ID no. 1897134
  misc_feature (1)..(1836): Encodes the peptide sequence at SEQ ID NO. 418
atctgctgtctccaagctgtcccaagtcctctttcccctgacccctctaaaatctccccagcgacagcgagagagagagagagaggagggaggacgagcgcattcgcatcgtggcaacaggcaccaagggtgattgtttcgaggagcgtggagcggagccatggggaagaagggcaagtggttcggcgcggtcaagaaagtgttcagccctgaatccaaggagaagaaggaggagaggcagaggaggaaatcagcagctagcaaccctactccactagatctgaccccgtcgacctccttggaagtcaatgtttcggtgccaccccctccagctcctccggctcttcaccagattgaggaggtcaggatccctgaagctgagcaggagcagagcaagcacatcaccgtagaggaggcccctgctgcccctgcacaggcgtcggtgcttccacctggtgtgccaagtgaagagcttgctgcaatcaagatccagactgccttccgaggttacctggcaaggagggcactgcgagcgctgcggggccttgttcgattgaagtcattggttgagggtgattcagttaggcgtcaatctgcaagcactctgcgctgtatgcagactctatcgcgggtgcagtcacaaatacgttctaggagagcaaagatgtctgaggagaaccaggccctccagcgccagctcctactgaagcaggaactggagaatttcaggatgggtgagaactgggatgacagcactcaatccaaagagcaaatcgaggcgagcctaataagcaggcaagaggcagcgattagaagagaaagagcgcttgcatatgcattttcacatcagtggaagagcacgtcgaggtctgtcaacccaatgtttgtagacccaaacaacttgcagtgggactggagctggctggagcgctggatggctgcaaaaccttgggagggccgcaatgggactgataaggagagcaatgttgaccgtggatccgttaagagcatgagcttgaaccttggagagggtgagatcactaaagctttcaaccgccgggactcaaagccagaaaagccatccccgccaactccaaaactgacccgtccagcctccaggcaatccccttcgacgccctccgctaaagtagcgccaatacctgtgaggagaaaatccgtcacgccaaagaatgggctttcacatgtggatgacgatgtgagaagtgtgttcagtgtgcagtctgagcgaccaaggaggcacagtatagccacctcgactgtgcgggacgatgagagtctcgcaagctccccatcactcccaagttatatggttcccacagaatctgcaagggcgaagtctcgtctccagggatcagcattgaataatggtgcagagacaccagagaaaggaagctctgctggaccggtcaagaaaaggttgtcctttcaaggtggaacagcggctgcctcaccaatgcgacggcattctggtcctcccaaggtggggagtgcggtgaaggatattgttgccccaccacagccagaggccttggtgatcaatggtggaagcaagtgactcatgacaagtaccaggagggtaaagcggacaatgaatatatattttatccatgaagaaaggttaacgtgatatcagctctatgagtgatttgaattgttttccagttacgaccacattgtttgctctataagattcacagtacctgccagttgattccattcgttgtttctgtaaaacaagtaccggttcgtcactagaatcagtgatgtttgtatgtaaacaggtcttctatttatgtgagccatatatttcttctc

SEQ ID NO: 418 - protein, 471 aa, Panicum virgatum
  misc_feature (1)..(471): Ceres Clone ID no. 1897134
  misc_feature (106)..(124): Pfam Name: IQ Pfam Description: IQ calmodulin-binding motif
  misc_feature (1)..(471): Bit score of 951.3 for HMM based on sequences of Figure 1
  misc_feature (1)..(471): Functional Homolog Of SEQ ID NO. 353
MGKKGKWFGAVKKVFSPESKEKKEERQRRKSAASNPTPLDLTPSTSLEVNVSVPPPPAPPALHQIEEVRIPEAEQEQSKHITVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWDWSWLERWMAAKPWEGRNGTDKESNVDRGSVKSMSLNLGEGEITKAFNRRDSKPEKPSPPTPKLTRPASRQSPSTPSAKVAPIPVRRKSVTPKNGLSHVDDDVRSVFSVQSERPRRHSIATSTVRDDESLASSPSLPSYMVPTESARAKSRLQGSALNNGAETPEKGSSAGPVKKRLSFQGGTAAASPMRRHSGPPKVGSAVKDIVAPPQPEALVINGGSK

SEQ ID NO: 419 - DNA, 2015 bp, Panicum virgatum
  misc_feature (1)..(2015): Ceres Clone ID no. 1859266
  misc_feature (1)..(2015): Encodes the peptide sequence at SEQ ID NO. 420
tcactctcgccactgctcccagctgttgcgacttgcgacctccgatcatccaaggctcctgcacccctgtcagtcctagctccagccaaaaatcgttggcttccgctgcctgctcctccgccttgcacctcccatgaccttccacgcgacatgattgcattgcaggcccctgcggagctcagtgtcctcccacgccgctgacgccttcttgttgcctccccgctgctgcgcacaaccgaaagggccttcctctcttcctttgcttccgcggaaagatttggcgatttgttcatctactaaagttgcatctctcttggtgattgtttcgaggagtgtggagtgaagccatggggaagaagggcaagtggttcggcgcggtcaagaaagtgttcagccctgaatccaaggagaagaaggaggagaggcagaggaggaaatcagcagctagcaaccctactccacgagatctgaccccgtcgacctccttggaagtcaatgtttcggtgccaccccctccagctcctccggcccttcaccagattgaggaaatcagggcccctgaagctgagcaggagcagagcaagcacgtcaccgtagaggaggctcctgctgcccctgcacaggcgtcggtgctgccacctggtgtgccaagtgaagagcttgctgcaatcaagattcagactgccttccgaggttacctggcaaggagggcactgcgagcgctgcggggccttgttcgattgaaatcattggttgagggtgattcagttaggcgtcaatctgcaagcactcttcgctgtatgcagactctatcgcgggtgcagtcacaaatacgttctaggagagcaaagatgtctgaggagaaccaggcccttcagcgccagctcctactgaagcaggaactggagaatttcaggatgggtgagaactgggatgacagcactcaatccaaagagcaaatcgaggcaagcctaataagcaggcaagaggcagcgattagaagagaaagagcgcttgcatatgcattttcacatcagtggaagagcacttcgagatctgtcaacccaatgtttgtagacccaaacaacttgcagtggggctggagctggttgaagcgctggatggctgcaaaaccttgggagggctgcaatggggctgataaggagagcaacattgaccgtggatctgttaagagcatgagcttgaaccttggagagggtgagatcacaaaagctttcaaccgccgggactcaaagccagaaaagccatcaccgccaactccaaaactgacccgtccagcctccaggcaatccccttcgacgccctctgctaaagtagcgccaatacctgctaggagaaaatccgccacgccaaagaatgggctttcacatgtggatgacgatgcgagaagtgtgttcagcgtgcagtctgagcgaccaaggaggcacagtatagccacctcgactgtgcaggacaatgagagtctcgcaagctccccatcactcccaagttacatggttcccacagaatctgcaggggcgaagtctcgtctccagggatcagcattgactaatggtgcagagacaccggagaaaggaagctctgctggaccggtcaagaaaaggttgtcatttcaaggtggaacagcggctgcctcaccaatgcgacggcattctggtcctcccaaggtggacagtgtggtgaaggatattgttgccccaccacagccagaggccttggtgatcaatggtggaagcaagtgactcataccaggaggggaaagcggattatgaatatatattttatcgatgaagaaaggttaacgtgatatcagctcaatgagtgatttgaattgttttcttacgaccacattgtttgctctataagattcgcagtacctgccagttgattccattcgttgtttctgtaaaacaagtatcggttcgtcactagaatcaatgaagtttgtatgtaaacaggtcttctatttatgtgagccatatatttcttcttct

SEQ ID NO: 420 - protein, 471 aa, Panicum virgatum
  misc_feature (1)..(471): Ceres Clone ID no. 1859266
  misc_feature (106)..(124): Pfam Name: IQ Pfam Description: IQ calmodulin-binding motif
  misc_feature (1)..(471): Bit score of 949.0 for HMM based on sequences of Figure 1
  misc_feature (1)..(471): Functional Homolog Of SEQ ID NO. 353
MGKKGKWFGAVKKVFSPESKEKKEERQRRKSAASNPTPRDLTPSTSLEVNVSVPPPPAPPALHQIEEIRAPEAEQEQSKHVTVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLKRWMAAKPWEGCNGADKESNIDRGSVKSMSLNLGEGEITKAFNRRDSKPEKPSPPTPKLTRPASRQSPSTPSAKVAPIPARRKSATPKNGLSHVDDDARSVFSVQSERPRRHSIATSTVQDNESLASSPSLPSYMVPTESAGAKSRLQGSALTNGAETPEKGSSAGPVKKRLSFQGGTAAASPMRRHSGPPKVDSVVKDIVAPPQPEALVINGGSK

SEQ ID NO: 421 - protein, 476 aa, Zea mays
  misc_feature (1)..(476): Public GI ID no. 194696788
  misc_feature (110)..(128): Pfam Name: IQ Pfam Description: IQ calmodulin-binding motif
  misc_feature (1)..(476): Bit score of 953.0 for HMM based on sequences of Figure 1
  misc_feature (1)..(476): Functional Homolog Of SEQ ID NO. 353
MGKKGKWFGAVKKVFSPESKEKKEERLRRKSAASNPAPVDLTPSTSLEVNVSVPPPPAPPPVPRQTDEVRVPEAEQEQSKHVTLEEAPAAAAAPAQAPVLPPGAPTEELAAIKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSANPMFVDPNNLQWGWSWLERWMAAKPWEGRNGTDKESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 422 - DNA, 1455 bp, Populus trichocarpa
  misc_feature (1)..(1455): Ceres Annot ID no. 1475350
  misc_feature (1)..(1455): Encodes the peptide sequence at SEQ ID NO. 423
atggggaggaaaggaaaatggttttctagtgtaaagaaagctcttagccctgatcccaaggagaagacagaccagaaatcaaataaatcaaagaagaaatggtttggaaagcaacaactggattcggattccacttctttagaaaatgtcacaatgctgtctcctcctccccaaccagaagaagtgaaattaattgagacaacagatgaagtgaaccagcatactttccctgttccagttgccactgctgcagtacctgagcctgctccgactactgtccaaaccaatattgaggttgttcaactgaccaaggtaaacaaatatgctggcaaatcaaaggaagaagaggcggcaattaagattcaaacaacattcagaggatacatggccagaagagcattgcgggctctgagagggttggcgaggctcaaatttctgatggaagggcctagaataaaaaggcaagcaacacataccctccgctgcatgcagactctagctcgggtgcagtcacagattcacacaaggaggatcagaatgtcagaagagaaccaggccctacagagacaactcctacagaagcatgccaaagagcttgaaaacttgcggggcatgcaatgttttcatattggagaggaatgggatgacagtctacagtcgaaggaacagattgaagctagcctgctaaacaagtttgaggccgctacgagaagggaaagagcactggcttatgctttctctcatcagcaaactttgaagaattcttcacgatctgcaaaccccatgttcatgaatgggaatccttcctggggttggagctggttggaacgatggatggcagcccatccatgggagagccggagcttgatggagaaagaacacaataacgaccactcatctgtaaagagtgccagccgcagcattactggaggagaaataagcaaatcttatgctcgctaccagctcaattctgataaattaactccaagagaaagtgaaaggccaaccaaaaccacgaacctacagtccccatcaactcctaaaaagccagctgcttctacagttgctagaaaattgaagtcagcaagcccaaggagtaacattgggggcattgaagatgactctagaagcatggtcagtgttcaatcagatcgtagtagaaggcatagcattgctggttcatttgtgcgagatgatgagagcctcggaagctctccagcgcttccaagttacatggtacctacacaatctgcaagagcaaagtccagaatacatagcctattgggagcagaaaaggacgggacaccagaaaaggaaaagggttcctctgggcatacaaagaaacggctttcataccctccatcgccagccaaaggaaggaggtattctggccccccaaagttggaaagcagcttcaatgcaagaaatagcgtggctgctggcgagggaatttaa

SEQ ID NO: 423 - protein, 484 aa, Populus trichocarpa
  misc_feature (1)..(484): Ceres Annot ID no. 1475350
  misc_feature (116)..(135): Pfam Name: IQ Pfam Description: IQ calmodulin-binding motif
  misc_feature (1)..(484): Bit score of 825.8 for HMM based on sequences of Figure 1
  misc_feature (1)..(484): Functional Homolog Of SEQ ID NO. 353
MGRKGKWFSSVKKALSPDPKEKTDQKSNKSKKKWFGKQQLDSDSTSLENVTMLSPPPQPEEVKLIETTDEVNQHTFPVPVATAAVPEPAPTTVQTNIEVVQLTKVNKYAGKSKEEEAAIKIQTTFRGYMARRALRALRGLARLKFLMEGPRIKRQATHTLRCMQTLARVQSQIHTRRIRMSEENQALQRQLLQKHAKELENLRGMQCFHIGEEWDDSLQSKEQIEASLLNKFEAATRRERALAYAFSHQQTLKNSSRSANPMFMNGNPSWGWSWLERWMAAHPWESRSLMEKEHNNDHSSVKSASRSITGGEISKSYARYQLNSDKLTPRESERPTKTTNLQSPSTPKKPAASTVARKLKSASPRSNIGGIEDDSRSMVSVQSDRSRRHSIAGSFVRDDESLGSSPALPSYMVPTQSARAKSRIHSLLGAEKDGTPEKEKGSSGHTKKRLSYPPSPAKGRRYSGPPKLESSFNARNSVAAGEGI

SEQ ID NO: 424 - protein, 484 aa, Hordeum vulgare
  misc_feature (1)..(484): Public GI ID no. 326490361
  misc_feature (1)..(484): Hordeum vulgare subsp. vulgare
  misc_feature (118)..(136): Pfam Name: IQ Pfam Description: IQ calmodulin-binding motif
  misc_feature (1)..(484): Bit score of 898.0 for HMM based on sequences of Figure 1
  misc_feature (1)..(484): Functional Homolog Of SEQ ID NO. 353
MGKKGKWLGAVKKVFSPESKEKKEEKLRKKLAARDPSPPDLTPSTSLEVNVSMPPPPPAVPSPHQTEEVQVRDVELELELELEQEQEQSKHVTVEAAPDAPAQTSAALPPGVSREELAAIKIQTAFRGYLARRALRALRGLVRLKSLVEGNSVKRQAASTLRCMQTLARVQSQIRSRRLKMSEENQALQRQLLLKQELDSLRMGEHWDDTTQSKEKIEASLISRQEAAIRRERALAYAFSHQWKSSSRSSNPMFVDPNNPHWGWSWLERWMAAKPSEAGRTGTGKESNIDQGSVKSMSLNLGEGEITKAFNRRGSKPDKSSPTTPKLTRPASRLSPSTPTAKVTPIVVKKKPATPKNGLSQVDDDARSVLSVQSERPRRHSIATSTVRDDESLASSPSVPSYMAATKSARAKSRLQGSPLIDSAETTPEKGGSVSIGSAKKRLSFPAGGAPPSPMRRHSGPPKVESMVKDIAVTPQPEALAING

SEQ ID NO: 425 - protein, 472 aa, Populus trichocarpa
  misc_feature (1)..(472): Public GI ID no. 224140165
  misc_feature (110)..(129): Pfam Name: IQ Pfam Description: IQ calmodulin-binding motif
  misc_feature (1)..(472): Bit score of 827.8 for HMM based on sequences of Figure 1
  misc_feature (1)..(472): Functional Homolog Of SEQ ID NO. 353
MGRKGKWFSSVKKALSPDPKEKTDQKKWFGKQQLDSDSTSLENVTMLSPPPQPEEVKLIETTDEVNQHTFPVPVATAAVPEPAPTTVQTNIEVVQLTKVNKYAGKSKEEEAAIKIQTTFRGYMARRALRALRGLARLKFLMEGPRIKRQATHTLRCMQTLARVQSQIHTRRIRMSEENQALQRQLLQKHAKELENLRIGEEWDDSLQSKEQIEASLLNKFEAATRRERALAYAFSHQQTLKNSSRSANPMFMNGNPSWGWSWLERWMAAHPWESRSLMEKEHNNDHSSVKSASRSITGGEISKSYARYQLNSDKLTPRESERPTKTTNLQSPSTPKKPAASTVARKLKSASPRSNIGGIEDDSRSMVSVQSDRSRRHSIAGSFVRDDESLGSSPALPSYMVPTQSARAKSRIHSLLGAEKDGTPEKEKGSSGHTKKRLSYPPSPAKGRRYSGPPKLESSFNARNSVAAGEGI

SEQ ID NO: 426 - protein, 461 aa, Ricinus communis
  misc_feature (1)..(461): Public GI ID no. 255577665
  misc_feature (119)..(137): Pfam Name: IQ Pfam Description: IQ calmodulin-binding motif
  misc_feature (1)..(461): Bit score of 975.9 for HMM based on sequences of Figure 1
  misc_feature (1)..(461): Functional Homolog Of SEQ ID NO. 353
MGKKGGWFSAFRKALSPKKSKSKKQEKDPDLVVSSYEETALAAPVPPPPPPPPLPPPPRPAEDVKLTEAESEQSKHAYSVALATAVAAEAAVAAAQAAAEVVRLTSTACYCGKSREEVAAIKIQTAFRGYLARRALRALRGLVRLKTLIQGQSVKRQAANTLRAMQTLARVQSQIRARRARMSEENQALQRQLQQKREKELEKLRSAIGEQWDDSAQSKEQQAWKNSSKSANATFMDPNNPHWGWSWLERWMAARPWESRSTVDNNDRASVKSTMSRALSIGEISRAYSRRDLDHDKPSPGAQKSTRLPSRQSPSTPPSKAPSTSSVTGKIKPPSPRGSAWGGDDDSRSLFSVQSERYRRHSIAGSSVRDDESLASSPSVPSYMAPTQSAKAKSRLPSPLGVDKDGTRDKASVASAKKRLSFSGSPAGLRRHSGPPRVNSSIMNNIEMHIEEQVNKGESGR

SEQ ID NO: 427 - DNA, 2163 bp, Gossypium hirsutum
  misc_feature (1)..(2163): Ceres Clone ID no. 1886384
  misc_feature (1)..(2163): Encodes the peptide sequence at SEQ ID NO. 428
aaacttttattccttccgtaaaggttcttctttgtttaaaactcaatttttattcctaatatctactgttcccccatgattttgcctcttaagatgggaaagaaagggaaatggttgtcctctctaaagaaagccttcttctcagagtccaagggaaagaaaaaccagaaatcaaaagaacaatttttggagaaggtgcatttggatcccactggttctgatgcagccaagttatccccacttcctcagcctgaagaggtgaaattaattgaacctgaagttgagcaaagcaagcagacttaccctgtggcagttgccaattctcctgccgttccagctcaggttgctctacaggccattcgacatcaacttaatacagatgctaggtttgccggaaaatctaaggaggaagtggcggcaatcaaaattcaagcagctttccgagcttaccttgcaaaaagggcattgcgtgctttaagaggactggctaggttgaaatcactgatggaagggcctgccgccagacggcaagcagccggttcccttcggtgcttgcagactctttctcgtatgcagtgtcagattcatgctcggagaaccaggatgatggaagaaaaccaggctcttcagaggcaactcttgcagaaacatgcgaaagagattgtgaacttgcaaatgggtgaagattgggatgacactgtgcggtcaaaggaacaaattgaggcaagcttgttgagcaaacatgaggctgccatgagaagagaaagggccatggcgtactcatttactcatcagcaaacctggaagaatgcttcgagatctatgaatccattgttcatggatccaagcaatccctcatggggatggagctggatggaacggtggatgacagcccggccatgggaggttcgtggtggcatgagagataaagaacatctcgatgaccagtcatccctaaagagtgcacgaagcaacttcggtggagaaatcagcaaagcttatgctcgttatcaactcaatttggataagcaatccacgaaggccaaccaaaagccaagccgaacttcgagcctcctatccccttctactcctaagtcagcatccataccagcccgaaagctgaagtcagcaagcccgaggagtggtgtggctggtttagatgatgaaacaagaagcatagtcagtatgaagtctgacagaaaccggagacacagcatcgcaggctcctcagtgcgtgataatgagagccttgccaactctccatcacttccaagttacatggtaccaactaagtctgcaagagttaagaccagtttgcagagccccttgggaccagaagcaaatggaacacctgagaaggatccaattggatctgctaagaaacggctttcttatccgccttcaccggccaggctaaggcgccactcctgtctgccaaaagtggacggtagcattagcaatacaaaagttgcagtggtgaatggaggggacggttttttcaaataaaaaagagatgaagtcctgatgcacgctaatccagaagaatcggaaaagaagagagaaactttgtatgtttcaaaagttagttaactaacgggattgtcgttgcacccaaaacaccccgttttcattaaagtgttgcatcgttttattaactttgagccctagtattttaaaaaaaatagtagagatctcttcttgctctctctcccttttcttgcggctagggttttgaaacccctcatcgccgttgttgccacggtgccaccacaagcggtggtaagggcggtgcgagctggcctaccctgaggtgtccccgaaggccaagccttcttaacccaaaagttgcgaaagaaaggtcttcccctccttattcggtccgatcccggtgacggaggagagccctccgcgaagaaatcacgagcgattccagtgttgcgcgacgaatggaagaggtggcgtgtggtgcgatgaaacggcgcgcgttggtggccatgctggtggggagcggcggctgaaggcttggtggctagggtttgctgaaaattttgtttgtgttgtgggcttggactattagggtttgtgaattaggtttgggtattgtcttatttgggccattttaatatataaagggactgttaataaacatttggattttcaccc

SEQ ID NO: 428 - protein, 470 aa, Gossypium hirsutum
  misc_feature (1)..(470): Ceres Clone ID no. 1886384
  misc_feature (108)..(126): Pfam Name: IQ Pfam Description: IQ calmodulin-binding motif
  misc_feature (1)..(470): Bit score of 733.1 for HMM based on sequences of Figure 1
  misc_feature (1)..(470): Functional Homolog Of SEQ ID NO. 353
MGKKGKWLSSLKKAFFSESKGKKNQKSKEQFLEKVHLDPTGSDAAKLSPLPQPEEVKLIEPEVEQSKQTYPVAVANSPAVPAQVALQAIRHQLNTDARFAGKSKEEVAAIKIQAAFRAYLAKRALRALRGLARLKSLMEGPAARRQAAGSLRCLQTLSRMQCQIHARRTRMMEENQALQRQLLQKHAKEIVNLQMGEDWDDTVRSKEQIEASLLSKHEAAMRRERAMAYSFTHQQTWKNASRSMNPLFMDPSNPSWGWSWMERWMTARPWEVRGGMRDKEHLDDQSSLKSARSNFGGEISKAYARYQLNLDKQSTKANQKPSRTSSLLSPSTPKSASIPARKLKSASPRSGVAGLDDETRSIVSMKSDRNRRHSIAGSSVRDNESLANSPSLPSYMVPTKSARVKTSLQSPLGPEANGTPEKDPIGSAKKRLSYPPSPARLRRHSCLPKVDGSISNTKVAVVNGGDGFFK

SEQ ID NO: 429 - protein, 466 aa, Ricinus communis
  misc_feature (1)..(466): Public GI ID no. 255568402
  misc_feature (104)..(123): Pfam Name: IQ Pfam Description: IQ calmodulin-binding motif
  misc_feature (1)..(466): Bit score of 736.0 for HMM based on sequences of Figure 1
  misc_feature (1)..(466): Functional Homolog Of SEQ ID NO. 353
METLSLNCFQFMKSKKKWFGKQHQLYSDSISIENARDLSPPLPPPQPEEVKTIETTNEQNVHAAYSVPVAAAAAEPVLPPLETTMEVVRVVKVNKFAGKSGEEMAAIKIQTAFKGYLARRALRALRGLGRLKSLMEGPTIKRQATHTLRCMQTLARVQSQIHSRRIRMSEENQALQRQLLQKHAQELEKLRMGEEWDDSLQSKEQIEANLLNKYEAAMRRERALAYSFTHQQTWKNSSRSANPIFMSSSNPTWGWSWLERWMAAHPWEKGGMTEKELSNDHSSVKTASRSMVGGEISKSYARYQLNSDKLSPAESEKVRQAMSPRSPLTPSKPGSSTIARKLKSASPRSSIGGADDDNRSIISMQSDRYRRHSIAGSSVRDDESLGSSSAVPSYMVPTESARAKSRLQSPLGVDKNGTSEKEKGPLGPAKKRLSYPPSPARPRRQLGPRKMESNLNAEIAVTNGQG

SEQ ID NO: 430 - DNA, 1726 bp, Gossypium hirsutum
  misc_feature (1)..(1726): Ceres Clone ID no. 1942871
  misc_feature (1)..(1726): Encodes the peptide sequence at SEQ ID NO. 431
gtttcttcttcaatttgtctgaaaaacataacctttccttcttctcaagatctgtttttgttctttctctgtaactgtttaccgacacacacacaaaaaaaaagttcgttcttccgaatttcttgagatctgggcattattgtttcaggatcatatcgaggaaagaaaagatggggaagaaagtaaaatggctatcttctttaaagaaagccttcaatccagagtcaaaggaaaagaaaaatcagattttggataagcaagtgcatttgggtcctagtagttctaatgcggctgcacccacattagaaactgttaatttgtcccctccacctcagccggaagatgagaaaataatcaaacccgagacggttgctgaagctaccgatgatgatgttgttgttgctccagctgttccgaccccggctgctgttacggtcgttcaacgccgacttaatatagactctcggtttgctggaaaatctatggaggaagttgcagcgatcaaaattcagacagcttttcgagtttacatggcgaaaagagcattgtgtgctttacgaggacttgtgaggctgaaatcgttaatggaaggacctgcggtgaaacggcaagtgacgagtacccttcgttgtatgcaaacactttctcgtgtgcagtgtcagattcggatgaggagaatccgtatgaccgaagaaaatcaagctcttcagagacaaatcttgcagaaacatgcgaaagagcttgtgaatttgcagatgggggaagattgggacgatagcttgcaatcgaaggaacaaatcgaagcgagcttattgagcaaacacgaggctgcaatgagacgagaaagggcaatggcttattcatttactcatcagcaaacttggaagaacggttcgaaatctatgaatccgttattcatggatatgaacaacctgacgtggggttggagttggttagaacgatggatggcagctcgaccatgggaaggacgtggcgtgacgggaaaggaaccgaacaacgaccagtcatcggtaaagagtgcacatttcgaaggagaaatcagcaaagcttacgctcgttaccaactcaatttggataataaacaatccccgaaatcgagccaaaagcctaaccgaacatcaagtcacctatccccttctccgaaaccaccttccacaccatccccaaagctgaagtccgcaagccctagcggcagtatcattgcccaggacgacgacacaagaagcatagtcagcgcgcaatccgaacggaaccgaagacacagcattgccggctcattggtgcgtgacgacgagagcttagcaagctcgccgtcacttccgagttatatggtaccaactaaatcggcaagagccaaaaccaggttgcaaagtcccttgggactagaagcaaatggtacacccgacaaaggaccgatcatgtcgaccaaaaaacgactcttgtatccaccttcaccggccaaaccgaggcggcactctggtccaccgagagtcgataccagcattattactaatacaaaaattggtgcggtgaatggtggtgtcatttaatttctctatatttttaattcatacaggttttatttgtgagatttgagaacaaactacgcataatttttagttcattgacaatttgttcattataattcttgtgctggtgttgtattgatttgtataataaattatatacattacttgtttatttt

SEQ ID NO: 431 - protein, 466 aa, Gossypium hirsutum
  misc_feature (1)..(466): Ceres Clone ID no. 1942871
  misc_feature (109)..(125): Pfam Name: IQ Pfam Description: IQ calmodulin-binding motif
  misc_feature (1)..(466): Bit score of 770.7 for HMM based on sequences of Figure 1
  misc_feature (1)..(466): Functional Homolog Of SEQ ID NO. 353
MGKKVKWLSSLKKAFNPESKEKKNQILDKQVHLGPSSSNAAAPTLETVNLSPPPQPEDEKIIKPETVAEATDDDVVVAPAVPTPAAVTVVQRRLNIDSRFAGKSMEEVAAIKIQTAFRVYMAKRALCALRGLVRLKSLMEGPAVKRQVTSTLRCMQTLSRVQCQIRMRRIRMTEENQALQRQILQKHAKELVNLQMGEDWDDSLQSKEQIEASLLSKHEAAMRRERAMAYSFTHQQTWKNGSKSMNPLFMDMNNLTWGWSWLERWMAARPWEGRGVTGKEPNNDQSSVKSAHFEGEISKAYARYQLNLDNKQSPKSSQKPNRTSSHLSPSPKPPSTPSPKLKSASPSGSIIAQDDDTRSIVSAQSERNRRHSIAGSLVRDDESLASSPSLPSYMVPTKSARAKTRLQSPLGLEANGTPDKGPIMSTKKRLLYPPSPAKPRRHSGPPRVDTSIITNTKIGAVNGGVI

SEQ ID NO: 432 - protein, 516 aa, Hordeum vulgare
  misc_feature (1)..(516): Public GI ID no. 326527367
  misc_feature (1)..(516): Hordeum vulgare subsp. vulgare
  misc_feature (143)..(161): Pfam Name: IQ Pfam Description: IQ calmodulin-binding motif
  misc_feature (1)..(516): Bit score of 898.9 for HMM based on sequences of Figure 1
  misc_feature (1)..(516): Functional Homolog Of SEQ ID NO. 353
MGKKPKWLGAVKKAFSPESKDQKLQRRLAAAAGGTSAPYPPDLTPSASYLEARASSAPPPLRYPDDFPEASLPPPPLPLPAPAPAPAPLPVPQTQTQEEHEIQHAAAAPPTDAPLPAAAAPPQAQAAIVQAPSSSPTLSRELAATKIQTAFRGHLARRALRALKGLVRLKSLVQGHSVKRQATSTLRCMQTLSRVQSKIRTRRIKMSEENQALQRQLLLNQELETLRMGDQWNTSLQSREQIEASMVSKQEAAARRERALAYAFSHQWKSTSRSANPMFVDPSNPHWGWSWLERWMASRPFDGRNGASEKEGSSVDRTSVNSTSLSMNLGEGEMITKADNNAYSLNPVDDGKPAASTPKPSVPASRQSPSTPSPVPARKKSTAPKSGDGDGGDDARSVVSTVRSERPRRHSIGASSVRDDASLSGSSPSVPSYMAATKSASARAKSRGQSPTLSEGAAHVETLEKGWSSVGSAKKRLSFPAGTPPPVPAPRRHSGPPKVRQAAVEGGTEERDSALV

SEQ ID NO: 433 - protein, 427 aa, Arabidopsis lyrata
  misc_feature (1)..(427): Public GI ID no. 297816500
  misc_feature (1)..(427): Arabidopsis lyrata subsp. lyrata
  misc_feature (110)..(127): Pfam Name: IQ Pfam Description: IQ calmodulin-binding motif
  misc_feature (1)..(427): Bit score of 595.6 for HMM based on sequences of Figure 1
  misc_feature (1)..(427): Functional Homolog Of SEQ ID NO. 353
MGKSWFSAVKKALSPEPKQKKDQKPHKAKKWFGKSKKLDVTNSGEADSPRTVKDAKLKEIEEQQSRHAYSVAIATAAAAEAAVAAAQAAAEVVRLSALSRFPGKSKEEIAAIKIQTAFRGYMARRALHALRGLVRLKSLVQGKCVRRQATSTLQSMQTLARVQSQIRERRHRLSEDKQALTRQLQQKHNKDFDKTGENWNDSTLSREKVEANMLNKQVATMRRERALAYAFTHQNTWKNSSKMGSQTFMDPNNPHWGWSWLERWMAARPNENQSVILTPDNADKESSSRAMSEMVPRGKNLSARGKTPNSRRGSSPRVRQVPSEDSNSMLSIQSEQPCNRRHSTCGSIPSTRDDESFTSSFSQSVPGYMAPTQAAKARARFSNLSPLSSEKTAKKRLCFSGSPKTVRRFSGPPKLESNLTKKDTNLA

SEQ ID NO: 434 - protein, 463 aa, Arabidopsis lyrata
  misc_feature (1)..(463): Public GI ID no. 297810377
  misc_feature (1)..(463): Arabidopsis lyrata subsp. lyrata
  misc_feature (117)..(136): Pfam Name: IQ Pfam Description: IQ calmodulin-binding motif
  misc_feature (1)..(463): Bit score of 1084.2 for HMM based on sequences of Figure 1
  misc_feature (1)..(463): Functional Homolog Of SEQ ID NO. 353
MGKKAKWFSSVKKAFSPDSKKSKQKLAEGQNGVISNPPVVDNVRQSSSSSPPPALPPREVRVAEVIDERNRDLSPPSTADAVNVRATDIPVVPSSSAPGVVRRATPARFAGKSNEEAAAILIQTIFRGYLARRALRAMRGLVRLKLLMEGSVVKRQAANTLKCMQTLSRVQSQIRARRIRMSEENQARQKQLLQKHAKELAGLKNGDNWNDSIQSKEKVEANLLSKYEATMRRERALAYAYSHQQNWKSNSKSGNPMFMDPSNPTWGWSWLERWMAGRPLESSEKEQNSNSNNDNAASVKGSINRNEAAKSITRNGSTQPNTPSSARGTPRNKNSFFSPPTPSRLIQSSRKSNDDDAKSTISVLSERNRRHSIAGSSVRDDESLAGSPALPSYMVPTKSARARLKPQSPLGGTTQENEGFTDKASAKKRLSYPTSPALPKPRRFSAPPKVESGGVAVTNEAGS

SEQ ID NO: 435 - protein, 499 aa, Selaginella moellendorffii
  misc_feature (1)..(499): Public GI ID no. 302762472
  misc_feature (117)..(136): Pfam Name: IQ Pfam Description: IQ calmodulin-binding motif
  misc_feature (1)..(499): Bit score of 426.3 for HMM based on sequences of Figure 1
  misc_feature (1)..(499): Functional Homolog Of SEQ ID NO. 353
MGKKKWFSAVKKAFGSPSKNEKEKTDTSSVKESEKLDNNNRKQIQDENQHQKKWNGATDDNSVLQTEDEQSKHAMAVAVATAAAAEAAVAAAQAAAAVVRLTGGRPSVHGGKPKEEWAAVKIQTAFRGYLARRALRALRGLVRLQALVRGHAVRRQATMTLRCMQALVRVQARVRARRVRMAEESQTLKNQVWQKRLEEQEALPDVETSVEVWDHSVKTAEEIQAKMQSKQEAAMKRERALAYAFSHQLWRSEPKDASAMYLDGDPEKSHWGWSWLERWMTARPWEGRAMEKDAPDGFSLKSTEDVVTKILEVDSGRFSSSGRRKQENELNSPSLTNKSNGNHTPSARGMLHSASPRSTRLVDDRTPRSTINNSLSAIAVKHPNNSSISSSVRDDESLASYPSVPSYMAPTESTRARSRSSSTPKQRPATPDKDAAKKRLSYPLADGVVPNSGPLRSSRNSGITQKSPGLKGKPGTGMSLQDSIGSDAPLLGEHTKRFR

SEQ ID NO: 436 - protein, 498 aa, Selaginella moellendorffii
  misc_feature (1)..(498): Public GI ID no. 302815615
  misc_feature (117)..(136): Pfam Name: IQ Pfam Description: IQ calmodulin-binding motif
  misc_feature (1)..(498): Bit score of 420.2 for HMM based on sequences of Figure 1
  misc_feature (1)..(498): Functional Homolog Of SEQ ID NO. 353
MGKKKWFSAVKKAFGSPSKNEKEKTDTSSVKESEKLDNNNRKQIQDENQNQKKWNGATDDNSVLQTEDEQSKHAMAVAVATAAAAEAAVAAAQAAAAVVRLTGGRPSVHGGKPKEEWAAVKIQTAFRGYLARRALRALRGLVRLQALVRGHAVRRQATMTLRCMQALVRVQARVRARRVRMAEESQTLKNQVWQKRLEEQEALPDVEASVEVWDHSVKTAEEIQAKMQSKQEAAMKRERALAYAFSHQLWRSEPKDASAMYLDGDPEKSHWGWSWLERWMTARPWEGRAMEKDAPDGFSLKSNEDVVTKILEVDSGRFSSSGRRKQENELNSPSLTNKSNGNHTPSARGMLHSASPRSTRLVDDRTPRSTINNSLPAIAVKHPNNSSISSSVRDDESLASYPSVPSYMAPTESTRARSRSSSTPKQRPATPDKDAAKKRLSYPLADGVVPNSGPLRSTRNSGITQKSPGLKGKPTGMSLQDSIGSDAPLLGEDTKRFR

SEQ ID NO: 437 - protein, 510 aa, Hordeum vulgare
  misc_feature (1)..(510): Public GI ID no. 326525172
  misc_feature (1)..(510): Hordeum vulgare subsp. vulgare
  misc_feature (118)..(136): Pfam Name: IQ Pfam Description: IQ calmodulin-binding motif
  misc_feature (1)..(510): Bit score of 233.6 for HMM based on sequences of Figure 1
  misc_feature (1)..(510): Functional Homolog Of SEQ ID NO. 353
MGKKVRWFDAVQRILSTSGPDREDKEEKQPAERLTTRSSFKKLWHFGKSSTSTSTTPETAHQQPGQQEAVEVAGDKSVGTTSEQNDGGFHVAPVAQQPAEATAIVMPRAPARSKEELAAVRIQTACRGYLVRRGYQTRAQARLMSLLEGVAVKRQTEEALYSMQAMTRVQTQIYARRVKKEKDLKSQVQPKQGPDKTKIGEGWDPTHQSKEQIEATLATKQEAASRRQRALSYAFSHQWRNRSPSSSSSGRGRVTPTQSHPPTFMDPGCPNWGWSWAERWTAAARPWESQTATQDKDRPAPAKGAKPRVSISVHIPTTPTGRSPRPPGRQSPSTPTRPLSPSVMGKTVASPRRAPSPRGSPFNRSGSVLSERPRTSQEHPGASSGGGGDEKEASLRRTTSLWSGELPRSLSLGVRDVDADETGGAPVTPSYMQATKSVKAKARCASPAAADRAELPERAPLVSSPSMKKRPSLELAEKQGVSSPRTPRTPGTPGKAKAEIRAKRPPSPRF

SEQ ID NO: 438 - protein, 499 aa, Picea sitchensis
  misc_feature (1)..(499): Public GI ID no. 116787496
  misc_feature (121)..(140): Pfam Name: IQ Pfam Description: IQ calmodulin-binding motif
  misc_feature (1)..(499): Bit score of 408.7 for HMM based on sequences of Figure 1
  misc_feature (1)..(499): Functional Homolog Of SEQ ID NO. 353
MDKKGSCFSVLKWAFCAKQKSHATKQGKKKGGCCFGSFRHHEPAAPKEDTRVKKTLGEGQEIRNEHEKPLVEVKEEQNSHASAVAVATAAAAEAAAAAAHAVAKVVRLTESYYSTNSPEECAAIKIQTAFRGYLVRRNFHTLRGLMRLQALVQGQSVRRQATNTMRCMQALVRVHSQICSRRIRMFEENQALQHHLQQKYEKELENRTSNSEADHQQDWESSLLTKEEIEARLQSKIEAAIKRERALAYAFSHHLWKNPPKSVQTMLMEIDPDKPHWGWSWLERWMATRPWDNHRMTMKENSTRKLQTIGEIGQKTSHIGLKQHNAEVTNIGTIKSDPFTPLSKPSIPNKMPLTGTDIKSDVNVLRSERPRYSSRYGVAGTSSLRDDESLMSSPRIPNYMASTESAKAKVRSQSTPKQRPGTPDTEPTSYRRKRLSFPLSEASSGPYRSTKGSMFPHTSPSLKGISGTSKSKKSVSSLRDLSIESDNSSLNWGHRKPFR

SEQ ID NO: 439 - protein, 321 aa, Zea mays
  misc_feature (1)..(321): Public GI ID no. 224029961
  misc_feature (108)..(126): Pfam Name: IQ Pfam Description: IQ calmodulin-binding motif
  misc_feature (1)..(321): Bit score of 597.8 for HMM based on sequences of Figure 1
  misc_feature (1)..(321): Functional Homolog Of SEQ ID NO. 353
MQTLSRVQSQIRSRRAKMSEENQALQRQLLLKQELENFRMGENWDDSTQSKEQIEASLISRQEAAIRRERALAYAFSHQWKSTSRSANPMFVDPNNLQWGWSWLERWMAAKPWEGRNGTDKESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 440 - protein, 449 aa, Eutrema halophilum
  misc_feature (1)..(449): Public GI ID no. 312282973
  misc_feature (109)..(126): Pfam Name: IQ Pfam Description: IQ calmodulin-binding motif
  misc_feature (1)..(449): Bit score of 562.7 for HMM based on sequences of Figure 1
  misc_feature (1)..(449): Functional Homolog Of SEQ ID NO. 353
MVKKAKWLKNVKKAFSPDLKKLKHQSVECQNSVISYPVLVATSRSSPPQFEVRVDEVNNEEKKKNLCPPPSDSVIATEEDVFVDSPPSSPEFVRPATPDRFAGKSKEEASAILIQSTFRGYLARRESREMRGLARLKLLMDGSVVQRQAANTLKCMQTLTRVQSQIRSRRVRMSEENQARHKQLLQKHAKELGGLKNGGNWNDSNQSKEQIEAGLLNKYEATMRRERALAYAFTHQQNLKSNSRSANPMFMDPSNPTWGWSWLERWMADRPWESSEKEQNNNSENSSVKTSSNRNSHRGETAKSSNRKNLNSSAQLNTPSSSSLSTTRIPRKNRPTPPSIKSKTTDENAKSSEKNRRHSIARSSVSDDENSTARRRNMVPTKSTRGKLKAQSSSSVSVITTTMEENGVLPQKAAAKKRISYSASPAPKPRRSSAPPKVENGLLKAVRTP

SEQ ID NO: 441 - protein, 454 aa, Arabidopsis thaliana
  misc_feature (1)..(454): Public GI ID no. 15232741
  misc_feature (109)..(126): Pfam Name: IQ Pfam Description: IQ calmodulin-binding motif
  misc_feature (1)..(454): Bit score of 529.3 for HMM based on sequences of Figure 1
  misc_feature (1)..(454): Functional Homolog Of SEQ ID NO. 353
MVKKAKWLKNVKKAFSPDSKKLKHESVECQDSVISYPVLIATSRSSSPQFEVRVDEVNYEQKKNLYPPSSDSVTATVAHVLVDSPPSSPESVHQAIVVNRFAGKSKEEAAAILIQSTFRGHLARRESQVMRGQERLKLLMEGSVVQRQAAITLKCMQTLSRVQSQIRSRRIRMSEENQARHKQLLQKHAKELGGLKNGGNWNYSNQSKEQVEAGMLHKYEATMRRERALAYAFTHQQNLKSFSKTANPMFMDPSNPTWGWSWLERWMAGRPWESSEKEQNTTNNDNSSVKNSTNRNSQGGETAKSSNRNKLNSSTKPNTPSASSTATRNPRKKRPIPSSIKSKSSDDEAKSSERNRRPSIARPSVSDDETLSSSTARRSSNLIPTTKSARGKPKSQTSSRVAVTTSTTEESSILPEKAPAKKRLSTSASPAPKPRRSSAPPKVEKGVLKAERTP

SEQ ID NO: 442 - protein, 602 aa, Selaginella moellendorffii
  misc_feature (1)..(602): Public GI ID no. 302806862
  misc_feature (118)..(137): Pfam Name: IQ Pfam Description: IQ calmodulin-binding motif
  misc_feature (1)..(602): Bit score of 163.1 for HMM based on sequences of Figure 1
  misc_feature (1)..(602): Functional Homolog Of SEQ ID NO. 353
MGKSTRWLLALIGLKKSSKKSSVEEQDVRKSSKDKRRWSFGKSAAAPADFAKPSSSSAREMDHSQNEQAKHAIAIAAASAAAAEAAVAAAHAAAAVVRLTGAANYASPVFELISREEWAAIKIQTAFRGYLARRALRALKAVVRIQALFRGHRVRKQAAITLRCMQALVRVQARVRARRVRMSKEGQAVQQQLLERRGRYRKSMDGWIASTGTVEDFHAKNERKHLGAMKRERALAYAFSQSNQLTKFLAELQSRTASPMVIDCEPDTPHWGWSWLERWMAARPWENPFEATSPVDSGCTKIVEVDYNNQSTNKLNPAKAPPPPPLSSTPPSSNTAIAKPAKKRSGSASESIPDAHKIVIPSPTNPAPPISTDRHGLSPNAQNLLSHPSPVIDHHHHADQSSSAAAIAASPKDLLALDDCFAKNTLKPLKNAAAAGAGTSAENQSFVQDFQQGIIRDMDLTLAGSSSELPAAAVPSYMATTQSSKAKVRSHSTPKQRPEQLLGLTMPDTPRKSMRNSMNGGHLLLAATTASGSFSSATAAANNAGSIAGALLRRGGSASSSQHGNGRGFSTGSMALDRSLISFKDGHASLSINGDMRKPFRF

SEQ ID NO: 443 - protein, 603 aa, Selaginella moellendorffii
  misc_feature (1)..(603): Public GI ID no. 302772817
  misc_feature (118)..(137): Pfam Name: IQ Pfam Description: IQ calmodulin-binding motif
  misc_feature (1)..(603): Bit score of 159.6 for HMM based on sequences of Figure 1
  misc_feature (1)..(603): Functional Homolog Of SEQ ID NO. 353
MGKSTRWLLALIGLKKSSKKTSVEEQDVRKSSKDKRRWSFGKSAAAPADFVKSSSSSAREMDHSQNEQAKHAIAIAAASAAAAEAAVAAAHAAAAVVRLTGAANYASPVFELISREEWAAIKIQTAFRGYLARRALRALKAVVRIQALFRGHRVRKQAAITLRCMQALVRVQARVRARRVRMSKEGQAVQQQLLERRGRYRKSMDGWIASTGTVEDFHAKNERKHLGAMKRERALAYAFSQSNQLTKLLAELQSRTASPMVIDCEPDTPHWGWSWLERWMAARPWENPFEATSPVDSGCTKIVEVDYNNQSANKLNPAKAPPPPPLSSTPPSSNTAIAKPAKKRSGSASESIPDAHKIVIPSPTNPAPPIATDRHGLSPNAQNLLSHPSPVIDHHHHADQSSSAAAIAASPKDLLALDDCFAKNTLKPLKNAAAAGVGTSAENQSFVQDFQQGIIRDMDLTLAGSSSELPAAAVPSYMATTQSSKAKVRSHSTPKQRPEQLLGLTMPDTPRKSMRNSMNGGHALLLAATTASGSFSSATAAANNAGSIAGALLRRGGSASSSQHGNGRGFSTGSMALDRSLISLKDGHASLSINGDMRKPFRF

SEQ ID NO: 444 - protein, 527 aa, Arabidopsis thaliana
  misc_feature (1)..(527): Public GI ID no. 240254538
  misc_feature (150)..(167): Pfam Name: IQ Pfam Description: IQ calmodulin-binding motif
  misc_feature (1)..(527): Bit score of 236.8 for HMM based on sequences of Figure 1
  misc_feature (1)..(527): Functional Homolog Of SEQ ID NO. 353
MGKNWLTCVSVACLSPGKDKKNQKPEKPKRKWSFGKQKSRESFDFPLEETPPVDPSPSSVHRPYPPPPPLPDFAPQPLLPPPSPPPPPPAYTINTRIYGESKESKNRQALALASAVAAEAAVVAAHAAAEVIRLTTPSTPQIEESKEETAAIKIQNAYRCYTARRTLRALRGMARLKSLLQGKYVKRQMNAMLSSMQTLTRLQTQIQERRNRLSAENKTRHRLIQQKGHQKENHQNLVTAGNFDSSNKSKEQIVARSVNRKEASVRRERALAYAYSHQQTWRNSSKLPHQTLMDTNTTDWGWSWLERWMASRPWDAESIDDQVSVKSSLKRENSIKSSPARSKTQKSASQSSIQWPVNNDTKSRKIEVTNRRHSIGGGSSENAKDDESVGSSSSRRNSLDNTQTVKSKVSVETTSNVSNAQTVKPKANVGAKRNLDNTKTLKSKSSVGTTGNLANTEAVKSKVNVGTTSMPKKEVVADKKKPPQMVLPKKRLSSSTSLGKTKKLSDSDKATTGVANGEKKRRNGGSS

SEQ ID NO: 445 - protein, 457 aa, Arabidopsis lyrata
  misc_feature (1)..(457): Public GI ID no. 297833734
  misc_feature (109)..(122): Pfam Name: IQ Pfam Description: IQ calmodulin-binding motif
  misc_feature (1)..(457): Arabidopsis lyrata subsp. lyrata
  misc_feature (1)..(457): Bit score of 528.2 for HMM based on sequences of Figure 1
  misc_feature (1)..(457): Functional Homolog Of SEQ ID NO. 353
MVKKAKWLKNVKKAFSPDSKKLKHESVECQDSVISYPVLIATSRSSPPQFEVRVDEVNYEQKKNLCPPSSVSVTPTVAHVLVDSPPSSPESVHQAIVDDRFAGKSKEDAAAILIQSTFRGNLSLSLSCVMRGQARLKLLMEGSVVQRQAAITLKCMQTLSRVQSQIRSRRIRMSEENQARHKQLLQKHAKELGGLKNGGNWNDSNQSKEQVEAGMLHKYEATMRRERALAYAFTHQQNLKSNSKTANPMFMDPSNPTWGWSWLERWMAGRPWESSEKEQNTTNNNNNENSSVKNSTNRNSHGGETAKSLNRNKLNISTQSNTPSSSSTATRNPRKKRPIPSPIKSKTSDDEAKSSEKNRRHSTARSSVSDDETLTSSTAKRSNHLIPTTKPVRGKPKPQSSSRAAVTTTTTEENSVLPEKAPAKKRLSTSASPAPKPRRSSAPPKVEKGALKAERTP

SEQ ID NO: 446 - protein, 516 aa, Arabidopsis thaliana
  misc_feature (1)..(516): Public GI ID no. 2739366
  misc_feature (139)..(156): Pfam Name: IQ Pfam Description: IQ calmodulin-binding motif
  misc_feature (1)..(516): Bit score of 198.7 for HMM based on sequences of Figure 1
  misc_feature (1)..(516): Functional Homolog Of SEQ ID NO. 353
MKDLSENFRRKWKPEKPKRKWSFGKQKSRESFDFPLEETPPVDPSPSSVHRPYPPPPPLPDFAPQPLLPPPSPPPPPPAYTINTRIYGESKESKNRQALALASAVAAEAAVVAAHAAAEVIRLTTPSTPQIEESKEETAAIKIQNAYRCYTARRTLRALRGMARLKSLLQGKYVKRQMNAMLSSMQTLTRLQTQIQERRNRLSAENKTRHRLIQQKGHQKENHQNLVTAGNFDSSNKSKEQIVARSVNRKEASVRRERALAYAYSHQQTWRNSSKLPHQTLMDTNTTDWGWSWLERWMASRPWDAESIDDQVSVKSSLKRENSIKSSPARSKTQKSASQSSIQWPVNNDTKSRKIEVTNRRHSIGGGSSENAKDDESVGSSSSRRNSLDNTQTVKSKVSVETTSNVSNAQTVKPKANVGAKRNLDNTKTLKSKSSVGTTGNLANTEAVKSKVNVGTTSMPKKEVVADKKKPPQMVLPKKRLSSSTSLGKTKKLSDSDKATTGVANGEKKRRNGGSS

SEQ ID NO: 447 - protein, 516 aa, Arabidopsis lyrata
  misc_feature (1)..(516): Public GI ID no. 297825811
  misc_feature (1)..(516): Arabidopsis lyrata subsp. lyrata
  misc_feature (139)..(156): Pfam Name: IQ Pfam Description: IQ calmodulin-binding motif
  misc_feature (1)..(516): Bit score of 193.3 for HMM based on sequences of Figure 1
  misc_feature (1)..(516): Functional Homolog Of SEQ ID NO. 353
MKDLSENFRRRWKPEKPKRKWSFGKQKSRDSFDFPVEETPTVDPSSSSVHRPSPPPPPLPDFAPQPLLPPPSPPPPPPAYTSNTRLYVDSKEAKNRQALALASAVAAEAAVVAAHAAAEVVRLTTPSTHQTEESKEETAAIKIQNAYRCYKARRTLRALRGMARLKSLLQGKYVKRQMNAMLSSMQTLTRLQTQIQERRNRLSAENKTRHRLIQQKGHQKENNQNLVTAGNFDSSNKSKEQIVARSVNRKEASVRRERALAYAYSHQQTWRNSSKLPHQTLMDTNTTDWGWSWLERWMASRPWDAESIDDQISLKNSLKRENSIKTSPARSKTLKSASQSSIQWPVNNDTKSKKIEVANRRHSIGGGSSANAKDDESVGSSSSRRNSLDNTQTVKAKVSVETTSNVTNAQPVKPKASVGTKRNLDNTKALKSKSSVGTTENLANTQAVKSKVNVGTTGLPKKEVVSDKKKPPQMVLPKKRLSSSTSLGKTKKLSDSDKATTGAANGEKKRRNGGSS

SEQ ID NO: 448 - DNA, 1543 bp, Zea mays
  misc_feature (1)..(1543): Ceres Clone ID no. 229668
  misc_feature (1)..(1543): Encodes the peptide sequence at SEQ ID NO. 449
cttggaagtcaatctttcggtgccaccgcctccagctcctcccccagttcttcaccaggccgaggaggttggggtccctgaagccgagcaggagcagagcaagcatgtcgccgtggaggaggcccctgctgccgccccagcgcaggcgtcggtgctgccacctgctgtgccaacccaagagctcgccgcagtcaagatccagaccgccttccgaggttacctggcaaggagggcactacgagcactgcgaggccttgttcgattgaagtcattggttgagggtaattcagtaaagcgtcaatctgcaagcactctgcgctgcatgcaaactctatcacgggtgcagtcacagatatcttccaggagagcaaagatgtccgaggagaaccaggctctccaacgccagctcctacttaaacaggaactggagaatttcagaatgggtgagaactgggatgacagcacccaatccaaggagcaaatcgaggcaagcctgataagcaggcaagaggcggcgataagaagagaaagagcgcttgcatatgcattttcacaccagtggaagagtacatcgagatctgtcaacccaatgtttgtagacccaaacaacctgcagtggggctggagctggctggagcgctggatggcagcaaaaccatgggaaggccgcaatggggctgacaaggagagcaacattgaccggggatccgttaagagcatgagcttgaaccttggagagggtgagatcacaaaagctttcaaccgccgggactcaaagctagaaaagccatcgccgccaactccaagaccggcccgtccaacttccaggcattcccctttgacgccctctgctagagtggcaccgatacctgcgaggagaaaatctgtcacgcccaagaacgggctttcacaggtggacgatgacgcgaggagcgtgctcagtgtgcagtctgagcggccaaggaggcacagtatagccacctcgactgtgcgggacgacgagagcctcacgagctccccgtcgctcccaagctacatggttcccacagaatctgcaagggccaaatctcgcctccagggttcagcaatggccaatggcgcagagacacctgagaaaggaggctcaactggaccagccaagaagaggttatccttccagggtggaactgcggctgcctcgccaatgcgacgacattctggtcctcccaaggtggagatcgcgccaccacaaccagaggccttggtagtcaatggtggaagcaagtgacacatatgtgatgagtaccaggatgagaaacggattatgaagatattagtttcattttcatccatgaatagaagttaaaagtggtatcatatctatgaatggtttcaattgtttttctgttacaaccacattatttgctatatacgattcacagtacctgccagttgattccattggttgtttctgtaaaacaaatatcaatttgtcactagaatctgtgatgtttgtatgtaaacagatcctctatttatgtgagacatatatttcttttctttc

SEQ ID NO: 449 - protein, 314 aa, Zea mays
  misc_feature (1)..(314): Ceres Clone ID no. 229668
  misc_feature (273)..(303): Pfam Name: IQ Pfam Description: IQ calmodulin-binding motif
  misc_feature (1)..(314): Bit score of 908.1 for HMM based on sequences of Figure 1
  misc_feature (1)..(314): Bit score of 662.4 for HMM based on sequences of Figure 1
  misc_feature (1)..(314): Functional Homolog Of SEQ ID NO. 353
MQTLSRVQSQISSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGADKESNIDRGSVKSMSLNLGEGEITKAFNRRDSKLEKPSPPTPRPARPTSRHSPLTPSARVAPIPARRKSVTPKNGLSQVDDDARSVLSVQSERPRRHSIATSTVRDDESLTSSPSLPSYMVPTESARAKSRLQGSAMANGAETPEKGGSTGPAKKRLSFQGGTAAASPMRRHSGPPKVEIAPPQPEALVVNGGSK

SEQ ID NO: 450 - DNA, 973 bp, Arabidopsis thaliana
  misc_feature (1)..(973): Ceres Clone ID no. 24255
  misc_feature (1)..(973): Encodes the peptide sequence at SEQ ID NO. 451
aacacatctctctctctctctctctctttctctctttttatatttttgtgtcccaatctcttcttcatttctgtttggttgccgagaaaacgcaggaaacttttctgcaaaaaaactcggtgaccatatttaaaactttcccacgttaattctctcttctttgttttgtttcagattcattacttttctccaaaaaactttcttcaagatctgctcttttaaataattatggcggaagaacatcgatgcgagacgcctgaaggtcaccgtctctgcgttaacaactgcggtttcttcggaagctcagcgacaatgaatctatgttcaaactgttacggcgatctctgtctcaaacaacaacaacaagcttccatgaaatcaaccgtcgaatcatctctctctccggtgatcgcacctgttctcgaaaactacgcggcggagttagagatcccgacgacgaagaagacagaggagaaaaaaccgattcaaattccgacggagcaaccgtctccgccgcaacggccgaatcgatgcaccgtatgtaggaaacgggtcgggttaaccgggtttatgtgtcggtgcgggacgactttttgtgggagtcataggtatccggaggttcatggttgtacgtttgatttcaaatcggcgggacgtgaagagatcgcgaaagctaatccgttggttattgcggcgaagcttcagaaaatatgaatcggagccgttgaccgatttctatctttaccctgagaaaatttcgattgtctcggtggatctcagccgttcattatgttattgtattacggacacgtgtcgcaagattaaggttgagatggtttcgtaactttttaattattttctttgtttatttccgaagaaattaaagtttttatgattgtgtggcttttgcttgtaaaaaaaaaaagggtttctctttgggaaaaagaaaagaaaatatatgaaattgtgtccc

SEQ ID NO: 451 - protein, 161 aa, Arabidopsis thaliana
  misc_feature (1)..(161): Ceres Clone ID no. 24255
  misc_feature (102)..(141): Pfam Name: zf-AN1 Pfam Description: AN1-like Zinc finger
  misc_feature (14)..(36): Pfam Name: zf-A20 Pfam Description: A20-like zinc finger
  misc_feature (1)..(161): Bit score of 410.8 for HMM based on sequences of Figure 3
  misc_feature (1)..(161): in Figure 3
MAEEHRCETPEGHRLCVNNCGFFGSSATMNLCSNCYGDLCLKQQQQASMKSTVESSLSPVIAPVLENYAAELEIPTTKKTEEKKPIQIPTEQPSPPQRPNRCTVCRKRVGLTGFMCRCGTTFCGSHRYPEVHGCTFDFKSAGREEIAKANPLVIAAKLQKI

SEQ ID NO: 452 - DNA, 709 bp, Gossypium hirsutum
  misc_feature (1)..(709): Ceres Clone ID no. 1931889
  misc_feature (1)..(709): Encodes the peptide sequence at SEQ ID NO. 453
ttctttcaccttttcctttcaagatcgagagaaaaaaagaatggcagaggagcatagatgccaagcgccagaaggccatcgtctttgcgtcaataactgcggctttttcggaaattcggcgacgatgaacctttgctccaaatgttacagagatctctgtctcaaggaacaggaagcttcttcgatcaaatccgctctttcctcttccccttcgtcttcgtcaacggttgtcgaatctatttctcaggttcctcttttggctctccctgaagtcaacagagaatcggcggtcccggagattgcaccggcggccgaacagctatcgcagcaacaaccgaatcggtgcatggtttgcaggaagcgggtcgggttgaccggattcagatgcaagtgcggtgttacgttttgcgggtcccacaggtaccctgagaatcacgggtgtacgttcgatttcaagaaggtcggcagagaggagatcgcacgcgctaatcccctcgtcaaagcagggaagctcgagaagatttgagtagaagatgatgatgatgggaagccaagccattgggaaattttcaaatttcatcaaactttgataagatcgagacacgtgcttcggttgtgggccgcaccacgaagagtaaaccaattgggctggataaatatattttcttcttaaaatataaatattttataataatattttaaattatgt

SEQ ID NO: 453 - protein, 161 aa, Gossypium hirsutum
  misc_feature (1)..(161): Ceres Clone ID no. 1931889
  misc_feature (102)..(140): Pfam Name: zf-AN1 Pfam Description: AN1-like Zinc finger
  misc_feature (14)..(37): Pfam Name: zf-A20 Pfam Description: A20-like zinc finger
  misc_feature (1)..(161): Bit score of 417.3 for HMM based on sequences of Figure 3
  misc_feature (1)..(161): Functional Homolog Of SEQ ID NO. 451
  misc_feature (1)..(161): in Figure 3
MAEEHRCQAPEGHRLCVNNCGFFGNSATMNLCSKCYRDLCLKEQEASSIKSALSSSPSSSSTVVESISQVPLLALPEVNRESAVPEIAPAAEQLSQQQPNRCMVCRKRVGLTGFRCKCGVTFCGSHRYPENHGCTFDFKKVGREEIARANPLVKAGKLEKI

SEQ ID NO: 454 - protein, 161 aa, Vitis vinifera
  misc_feature (1)..(161): Public GI ID no. 225440926
  misc_feature (102)..(140): Pfam Name: zf-AN1 Pfam Description: AN1-like Zinc finger
  misc_feature (14)..(37): Pfam Name: zf-A20 Pfam Description: A20-like zinc finger
  misc_feature (1)..(161): Bit score of 429.9 for HMM based on sequences of Figure 3
  misc_feature (1)..(161): Functional Homolog Of SEQ ID NO. 451
  misc_feature (1)..(161): in Figure 3
MAEEHRCEAPEGHRLCANNCGFFGSPATLNLCSKCYRDLRLKEEQASSAKSAVEKSLSAASSSTAPLSPPALTLPEAANEITVPAAVTAAVPSPSATQPNRCSTCRKRVGLTGFRCRCGITFCGVHRYPEQHGCTFDFKTLGKEAISKANPVVKAEKLHKI

SEQ ID NO: 455 - DNA, 1190 bp, Glycine max
  misc_feature (1)..(1190): Ceres Clone ID no. 708446
  misc_feature (1)..(1190): Encodes the peptide sequence at SEQ ID NO. 456
tataaatcaggtactaactctttctccttctcccctcatcccaatacccctttatttttttcgttttttttttatggaaaaaaatattgtagcaatttcgtcgtagaaacaaaattcccctattttcggcacgccgttgttgaatttccaatctgtgattttttttcttcttctatttatacgtgataattccaaaaagcctaacgcgagagattcatcagcttttcaattattcctcgaattattttgaaggaatcatccaaactgcttgaaatattcatcatcaacaacctcacgctgttatagatattctctctctctctctccctctctctctctctcacacacacacacacacagatccagacatggccgaagaacaccgatgccaagctcccgaaggtcacagactctgctccaacaactgcggtttctttggtagccccgccaccatgaatctctgttccaaatgctacagagacatccgtttgaaggaagaagaacaagccaaaaccaaatccacaatcgaaaccgctctttcaggatcttcctccgccaccgtcaccgcaaccgccgtcgttgcctcctccgtggaatccccttcggcgccggttgaatccctccctcaaccaccggtgctgatttcgccggatatagccgcaccggttcaggcgaaccggtgcggcgcgtgtaggaagcgcgtggggttgacagggttcaagtgcaggtgcggaacaacgttttgtgggagccacaggtaccccgagaaacacgcgtgtggcttcgatttcaaggcggtggggagagaggagatagcacgggcgaatcccgtgatcaaaggcgagaagctacggaggatttaatctgcgccgttggatgatcgaagcgattagggtgagttgatcaggaccgttcgtcgtggaccgttgatacgaaccgatttcgagcgtgtaaataaaaaaatctattattatgacgacattgggaagggttgaataagtcatattttggtggctttggtttgtgtttgtgcattaaaagtggaaaaatgttaggtccacccacgttcggaaattgaggggtttagaattgaaatgaaatgtaaaaaagtttagtttgattatttttctacggcatttctatttttctagtgggtggcgcgtttgccagaaagggaaattatcgtcggc

SEQ ID NO: 456 - protein, 164 aa, Glycine max
  misc_feature (1)..(164): Ceres Clone ID no. 708446
  misc_feature (105)..(143): Pfam Name: zf-AN1 Pfam Description: AN1-like Zinc finger
  misc_feature (14)..(37): Pfam Name: zf-A20 Pfam Description: A20-like zinc finger
  misc_feature (1)..(164): Bit score of 389.3 for HMM based on sequences of Figure 3
  misc_feature (1)..(164): Functional Homolog Of SEQ ID NO. 451
  misc_feature (1)..(164): in Figure 3
MAEEHRCQAPEGHRLCSNNCGFFGSPATMNLCSKCYRDIRLKEEEQAKTKSTIETALSGSSSATVTATAVVASSVESPSAPVESLPQPPVLISPDIAAPVQANRCGACRKRVGLTGFKCRCGTTFCGSHRYPEKHACGFDFKAVGREEIARANPVIKGEKLRRI

SEQ ID NO: 457 - protein, 166 aa, Ricinus communis
  misc_feature (1)..(166): Public GI ID no. 255575635
  misc_feature (107)..(145): Pfam Name: zf-AN1 Pfam Description: AN1-like Zinc finger
  misc_feature (14)..(37): Pfam Name: zf-A20 Pfam Description: A20-like zinc finger
  misc_feature (1)..(166): Bit score of 410.3 for HMM based on sequences of Figure 3
  misc_feature (1)..(166): Functional Homolog Of SEQ ID NO. 451
  misc_feature (1)..(166): in Figure 3
MAEEHRCEAPEGHRPCVNNCGFFGSAATMNLCSKCYRDYCLKEQHQHQQEASIKASLSVPSPSSAAAIVDNSQPAPSPDDVLRSPEAVEEEVKVVVTAIEQKQPNRCFVCRKRVGLTGFRCRCESMFCGAHRYPEKHNCTFDFKKIGREEIARANPLVVAQKLHKI

SEQ ID NO: 458 - protein, 165 aa, Lotus japonicus
  misc_feature (1)..(165): Public GI ID no. 193237563
  misc_feature (106)..(144): Pfam Name: zf-AN1 Pfam Description: AN1-like Zinc finger
  misc_feature (14)..(37): Pfam Name: zf-A20 Pfam Description: A20-like zinc finger
  misc_feature (1)..(165): Bit score of 417.1 for HMM based on sequences of Figure 3
  misc_feature (1)..(165): Bit score of 417.1 for HMM based on sequences of Figure 3
  misc_feature (1)..(165): Functional Homolog Of SEQ ID NO. 451
  misc_feature (1)..(165): in Figure 3
MAEEHRCEAPEGHRLCVNNCGFSGSPATMDLCSKCYRDIRLKEQQEASTKSTIETALSSSSSVAKPPSSTSSPSPAVDLAPPAKAETASISLTAGPILQAAQPNRCATCRKRVGLTGFKCRCEVTFCGAHRYPEKHACSFDFKTVGREAIARENPVVRAEKLRRI

SEQ ID NO: 459 - protein, 156 aa, Solanum pennellii
  misc_feature (1)..(156): Public GI ID no. 222822693
  misc_feature (99)..(137): Pfam Name: zf-AN1 Pfam Description: AN1-like Zinc finger
  misc_feature (14)..(37): Pfam Name: zf-A20 Pfam Description: A20-like zinc finger
  misc_feature (1)..(156): Bit score of 371.4 for HMM based on sequences of Figure 3
  misc_feature (1)..(156): Functional Homolog Of SEQ ID NO. 451
  misc_feature (1)..(156): in Figure 3
MAEEHGFEAPEGHILCANNCGFFGSPTTQNFCSKCYNEVYIKGGLQKPIDSLFPPQLPIPSTSSILVLQESAAAEEEPEVVTAAVAVAVQPIPAQPNRCSACRKKVGLTGFKCRCGTTFCGTHRYPEIHGCSFDFKSIGREAIAKANPVVKAKKLG

SEQ ID NO: 460 - protein, 159 aa, Populus trichocarpa
  misc_feature (1)..(159): Public GI ID no. 224103059
  misc_feature (100)..(138): Pfam Name: zf-AN1 Pfam Description: AN1-like Zinc finger
  misc_feature (11)..(34): Pfam Name: zf-A20 Pfam Description: A20-like zinc finger
  misc_feature (1)..(159): Bit score of 363.9 for HMM based on sequences of Figure 3
  misc_feature (1)..(159): Functional Homolog Of SEQ ID NO. 451
  misc_feature (1)..(159): in Figure 3
MAEEQHRCQEPRLCVNNCGFFGSPATQNLCSKCYGDLRQSQPLNQLLAPSSSASVSSFSSPTVDVIKNQIAPVLVVEGDEKGEFKAEPTVVVPQQKPNRCLTCRRRVGLTGFNCRCGMVFCGTHRYPEQHDCEFDFKSLGKEQIAKANPVVKGEKLQRI

SEQ ID NO: 461 - protein, 162 aa, Malus x domestica
  misc_feature (1)..(162): Public GI ID no. 302398693
  misc_feature (10)..(34): Pfam Name: zf-A20 Pfam Description: A20-like zinc finger
  misc_feature (103)..(140): Pfam Name: zf-AN1 Pfam Description: AN1-like Zinc finger
  misc_feature (1)..(162): Bit score of 399.2 for HMM based on sequences of Figure 3
  misc_feature (1)..(162): Functional Homolog Of SEQ ID NO. 451
  misc_feature (1)..(162): in Figure 3
MAEEHRCQPPQLCVNNCGFFGSPTTQNLCSKCYRDLQIKEQQVLALNQTLISSSSSPSSSCPLSSLPVSVSPAHEAQVERVIEAKEEEKEAAPSSAGAHANKCMTCRRRVGLTGFQCRCGMTFCGTHRYPEQHACGFDFRGMGKEQIAKANPVVKADKLQKI

SEQ ID NO: 462 - protein, 149 aa, Solanum lycopersicum
  misc_feature (1)..(149): Public GI ID no. 222822667
  misc_feature (100)..(138): Pfam Name: zf-AN1 Pfam Description: AN1-like Zinc finger
  misc_feature (14)..(37): Pfam Name: zf-A20 Pfam Description: A20-like zinc finger
  misc_feature (1)..(149): Bit score of 335.6 for HMM based on sequences of Figure 3
  misc_feature (1)..(149): Functional Homolog Of SEQ ID NO. 451
  misc_feature (1)..(149): in Figure 3
MAEEHGFEAPEGHILCANNCGFFGSPTTQNFCSKCYNEVYIKGGQQKPIDSLFPPSQLPIPSTSSILVLQESTAAEEEPEVVTAAVTVAVQPISAQPNRCSACRKKVGLTGFKCRCGTTFCGTHRYPEIHGCSFDFKSIGREAIAKANP

SEQ ID NO: 463 - protein, 181 aa, Picea sitchensis
  misc_feature (1)..(181): Public GI ID no. 116778998
  misc_feature (122)..(160): Pfam Name: zf-AN1 Pfam Description: AN1-like Zinc finger
  misc_feature (23)..(45): Pfam Name: zf-A20 Pfam Description: A20-like zinc finger
  misc_feature (1)..(181): Bit score of 391.2 for HMM based on sequences of Figure 3
  misc_feature (1)..(181): Bit score of 391.2 for HMM based on sequences of Figure 3
  misc_feature (1)..(181): Functional Homolog Of SEQ ID NO. 451
  misc_feature (1)..(181): in Figure 3
MDQENWNIGADGTGCQAPEGHTLCANNCGFFGSSATRNLCSKCYRDLIMKEAQATSAMAAVEKSFAAGSPMDEVPLSSPDAIVQQNRVQISAAVAGVSSVQLADSGSSSSSPQPPAETPNRCFSCRKRVGLTGFKCRCENTFCGLHRYAEKHSCSFDFKAAGREAIAKANPVVKAAKIDKL

SEQ ID NO: 464 - DNA, 775 bp, Musa acuminata
  misc_feature (1)..(775): Ceres Clone ID no. 1748922
  misc_feature (1)..(775): Encodes the peptide sequence at SEQ ID NO. 465
atagccaggctgctgcctcctccctctcccggacccttttaatcctccgcgaaatactattcttctcctcccctcctccctttggaatcggccacgcggttcaaggcaccgatttggtgttcgccttgttctcacataacaagattgaccggccgagcgattgatctgaaaagaaaggggagggaggagaatggcggaagagcagcgatgccaggagggccaccgcctctgcgcgaacaactgtggcttcttcgggagccccgcgacgctcaacctctgctctaaatgctaccgcgatcaccgcctcaaggaggagcaggagcgacagcagcagccggcctcttctgccgccgcctctgcgatgctcaccgtcgcgaaatccttccctgcctcttcccctgccgtcgtcgtggttgacgaggaggtgagcggcgcctccgtcccgagccggtgcgcgaggtgccgcaagagggtggggctgacggggttccagtgccggtgcggggccacctactgcggcgtccaccggtacgccgagcaacacgactgcacgttcgacttcaaggcggccggccgcgcgaccatcgcccgcgccaaccccgtcgtgaaggccgacaagctccacaagatctgaagaatctccaccctccgtctcccccttcccccggctcgatggacggccccgatctcgtcccggaagagaccccactcccttgtgatatgatgatgattgacggctttctggtggattgctttctccatttctttttttctt

SEQ ID NO: 465 - protein, 147 aa, Musa acuminata
  misc_feature (1)..(147): Ceres Clone ID no. 1748922
  misc_feature (88)..(126): Pfam Name: zf-AN1 Pfam Description: AN1-like Zinc finger
  misc_feature (12)..(35): Pfam Name: zf-A20 Pfam Description: A20-like zinc finger
  misc_feature (1)..(147): Bit score of 353.3 for HMM based on sequences of Figure 3
  misc_feature (1)..(147): Functional Homolog Of SEQ ID NO. 451
  misc_feature (1)..(147): in Figure 3
MAEEQRCQEGHRLCANNCGFFGSPATLNLCSKCYRDHRLKEEQERQQQPASSAAASAMLTVAKSFPASSPAVVVVDEEVSGASVPSRCARCRKRVGLTGFQCRCGATYCGVHRYAEQHDCTFDFKAAGRATIARANPVVKADKLHKI

SEQ ID NO: 466 - DNA, 979 bp, Panicum virgatum
  misc_feature (1)..(979): Ceres Clone ID no. 1775820
  misc_feature (1)..(979): Encodes the peptide sequence at SEQ ID NO. 467
atcgccagcgcgcgcgccggccgatctgggggcgggctccgctccacccgaggctcgccgttgacggggtccgcgtccatcggtagcaatggcacaagagagctggaaacaagagtccgaggagactagagtccacgcgcctgaggcccctattctctgcataaacaactgtggtttctttggcagcagcatgacgaacaatatgtgctcgaagtgctatagggacttcatcaagttgatggaagctcctgtggtggaaaagaaggtgaccacatcagcatcttcttccacagcaccactggagacaaagcgagatgatgcgcctgccgctgctgccactgaagctgtggctgagaagcaagcagagcaagagcccccaaagccacccagcaaccggtgtctgacttgccgcaagaaggtcgggctgaccggcttcctctgccgttgcggggacaccttctgctccacgcaccgctacaccgactcccaccagtgcacctttgactataagaaggtggcacgggagcagatagccaagcagaatccagttgtgatggccgagaagataaacaagatctaatgaatggttgtgaagggattcatgcctgggttcctgagtcctcaagttcactataatcgataggttccttcgggtggtggtctgggttagcgtggtagtagggggtctcaattgtgtctatccttctcctttatcatggttccattctctgccggaaagatgcagtggttttgcgtcgtcacttcctctggaagtagtttaagtcgagaagataagattgcacatcaggtattgcttattctggtcctggagggccaagtgttgtatcgacatgtcattggttttgtatcgttgtatgttatcacgtgtgctggaaatcacagcaagtatgaagcttatctgatcctgctaccatcatgtttatgtgatcagatgaagttatagataagcatacatatc

SEQ ID NO: 467 - protein, 163 aa, Panicum virgatum
  misc_feature (1)..(163): Ceres Clone ID no. 1775820
  misc_feature (21)..(45): Pfam Name: zf-A20 Pfam Description: A20-like zinc finger
  misc_feature (104)..(142): Pfam Name: zf-AN1 Pfam Description: AN1-like Zinc finger
  misc_feature (1)..(163): Bit score of 371.2 for HMM based on sequences of Figure 3
  misc_feature (1)..(163): Functional Homolog Of SEQ ID NO. 451
  misc_feature (1)..(163): in Figure 3
MAQESWKQESEETRVHAPEAPILCINNCGFFGSSMTNNMCSKCYRDFIKLMEAPVVEKKVTTSASSSTAPLETKRDDAPAAAATEAVAEKQAEQEPPKPPSNRCLTCRKKVGLTGFLCRCGDTFCSTHRYTDSHQCTFDYKKVAREQIAKQNPVVMAEKINKI

SEQ ID NO: 468 - protein, 171 aa, Oryza sativa
  misc_feature (1)..(171): Public GI ID no. 115468934
  misc_feature (1)..(171): Oryza sativa Japonica Group
  misc_feature (112)..(151): Pfam Name: zf-AN1 Pfam Description: AN1-like Zinc finger
  misc_feature (14)..(38): Pfam Name: zf-A20 Pfam Description: A20-like zinc finger
  misc_feature (1)..(171): Bit score of 389.1 for HMM based on sequences of Figure 3
  misc_feature (1)..(171): Functional Homolog Of SEQ ID NO. 451
  misc_feature (1)..(171): in Figure 3
MEHKETGCQQPEGPILCINNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCAMHRYSDKHDCQFDYRTAARDAIAKANPVVKAEKLDKI

SEQ ID NO: 469 - protein, 159 aa, Aeluropus littoralis
  misc_feature (1)..(159): Public GI ID no. 118424243
  misc_feature (100)..(138): Pfam Name: zf-AN1 Pfam Description: AN1-like Zinc finger
  misc_feature (16)..(40): Pfam Name: zf-A20 Pfam Description: A20-like zinc finger
  misc_feature (1)..(159): Bit score of 364.7 for HMM based on sequences of Figure 3
  misc_feature (1)..(159): Functional Homolog Of SEQ ID NO. 451
  misc_feature (1)..(159): in Figure 3
MAQESWKQESHAPEAPILCINNCGFFGSSMTNNMCSKCYRDFVKLMEMDAPVVDKKLITTASSSTVPFETAKQDDTVPDAAAMDDKQPAQEPPKPPSNRCSTCRKKVGLTGFQCRCGGTFCSLHRYTDSHECTFDYKKVAREQIAKQNPVVIAEKINKI

SEQ ID NO: 470 - protein, 172 aa, Vitis vinifera
  misc_feature (1)..(172): Public GI ID no. 147783026
  misc_feature (113)..(152): Pfam Name: zf-AN1 Pfam Description: AN1-like Zinc finger
  misc_feature (15)..(39): Pfam Name: zf-A20 Pfam Description: A20-like zinc finger
  misc_feature (1)..(172): Bit score of 339.0 for HMM based on sequences of Figure 3
  misc_feature (1)..(172): Functional Homolog Of SEQ ID NO. 451
MESHDETGCQAPEGPILCINNCGFFGSAATMNMCSKCHKDLALKQEQAKLAASSIGSIVNGSSSGNGKEPIVAGTVDVQAGPVEVKAISAEASNDSSSNQIIESKVKEGPNRCTACRKRVGLTGFNCKCGNLFCAVHRYSDKHDCPFDYRTAARDAIAKANPVVKAEKLDKI

SEQ ID NO: 471 - protein, 171 aa, Citrus hybrid
  misc_feature (1)..(171): Public GI ID no. 119367488
  misc_feature (1)..(171): Citrus hybrid cultivar
  misc_feature (15)..(39): Pfam Name: zf-A20 Pfam Description: A20-like zinc finger
  misc_feature (112)..(151): Pfam Name: zf-AN1 Pfam Description: AN1-like Zinc finger
  misc_feature (1)..(171): Bit score of 303.1 for HMM based on sequences of Figure 3
  misc_feature (1)..(171): Functional Homolog Of SEQ ID NO. 451
MESHDETGCQAPEGPILCVNNCGFFGSAATMNMCSKCHKAMILNQEQAQLAASSIGSIVHGSSGGTGKEPIIAGSVDLQVGPVEIKKFSMEPSSGSSFGFAGVKAKEGPKRCTTCNKRVGLTGFNCRCGNLFCAVHRYSDKHGCPFDYRTAAREAIAKANPVVKAEKLDKI

SEQ ID NO: 472 - protein, 172 aa, Vitis vinifera
  misc_feature (1)..(172): Public GI ID no. 147860340
  misc_feature (113)..(152): Pfam Name: zf-AN1 Pfam Description: AN1-like Zinc finger
  misc_feature (15)..(39): Pfam Name: zf-A20 Pfam Description: A20-like zinc finger
  misc_feature (1)..(172): Bit score of 295.1 for HMM based on sequences of Figure 3
  misc_feature (1)..(172): Functional Homolog Of SEQ ID NO. 451
MDHNETGCQAPPEAPILCINNCGFFGSAATMNMCSKCHKDLVLKQEQAKLAASSFESIVEGSSNCNAKESMVAIAKADIIQTGPSESMPVPTQAACASPSETNDRVKEGPNRCSSCRKRVGLTGFNCRCGNIFCAVHRYSDKHACPFDYRTAARDAIAKSNPVIKPEKLDKI

SEQ ID NO: 473 - protein, 141 aa, Vitis vinifera
  misc_feature (1)..(141): Public GI ID no. 147792975
  misc_feature (13)..(37): Pfam Name: zf-A20 Pfam Description: A20-like zinc finger
  misc_feature (82)..(121): Pfam Name: zf-AN1 Pfam Description: AN1-like Zinc finger
  misc_feature (1)..(141): Bit score of 234.4 for HMM based on sequences of Figure 3
  misc_feature (1)..(141): Functional Homolog Of SEQ ID NO. 451
MEQKSQENEVNAAILCANNCGFFGSAATNNLCSKCYKEFVIKQSKEASVVENENNTVGENSGSGIEEGAAAGSPEKCPANRCSFCRKRVGLTGFKCRCGQTFCSMHRYSDKHNCVFDYKSAAQDAIAKANPVVKADKIEKI

SEQ ID NO: 474 - protein, 208 aa, Homo sapiens
  misc_feature (1)..(208): Public GI ID no. 21359918
  misc_feature (11)..(35): Pfam Name: zf-A20 Pfam Description: A20-like zinc finger
  misc_feature (149)..(188): Pfam Name: zf-AN1 Pfam Description: AN1-like Zinc finger
  misc_feature (1)..(208): Bit score of 170.5 for HMM based on sequences of Figure 3
  misc_feature (1)..(208): Functional Homolog Of SEQ ID NO. 451
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKSLEKPKQKKNRCFMCRKKVGLTGFECRCGNVYCGVHRYSDVHNCSYNYKADAAEKIRKENPVVVGEKIQKI

SEQ ID NO: 475 - protein, 223 aa, Canis lupus
  misc_feature (1)..(223): Public GI ID no. 73951300
  misc_feature (1)..(223): Canis lupus familiaris
  misc_feature (11)..(35): Pfam Name: zf-A20 Pfam Description: A20-like zinc finger
  misc_feature (164)..(203): Pfam Name: zf-AN1 Pfam Description: AN1-like Zinc finger
  misc_feature (1)..(223): Bit score of 167.2 for HMM based on sequences of Figure 3
  misc_feature (1)..(223): Functional Homolog Of SEQ ID NO. 451
MAQETNHSQVPMLCSTGCGFYGNPRTNGMCSVCYKEHLQRQNSSNGRISPPAASVSTLSESLPVQCTDGSVADAQLPLDSTSASVQPSPVSNQSLLSESVASSQVDSTSVDKAVPETEDLQGPRAEGLVPPEWDPPPSVSDTAQQPSEEQSKSLEKPKQKKNRCFMCRKKVGLTGFECRCGNVYCGVHRYSDVHNCSYNYKADAAEKIRKENPVVVGEKIQKI

SEQ ID NO: 476 - protein, 170 aa, Oryza sativa
  misc_feature (1)..(170): Public GI ID no. 115477170
  misc_feature (1)..(170): Oryza sativa Japonica Group
  misc_feature (111)..(150): Pfam Name: zf-AN1 Pfam Description: AN1-like Zinc finger
  misc_feature (21)..(42): Pfam Name: zf-A20 Pfam Description: A20-like zinc finger
  misc_feature (1)..(170): Bit score of 189.7 for HMM based on sequences of Figure 3
  misc_feature (1)..(170): Functional Homolog Of SEQ ID NO. 451
MAQREKKVEEPTELRAPEMTLCANSCGFPGNPATNNLCQNCFLAASASSSSSSAAASPSTTSLPVFPVVEKPRQAVQSSAAAAVALVVERPTAGPVESSSKASRSSSVNRCHSCRRRVGLTGFRCRCGELYCGAHRYSDRHDCSFDYKSAARDAIARENPVVRAAKIVRF

SEQ ID NO: 477 - DNA, 894 bp, Gossypium hirsutum
  misc_feature (1)..(894): Ceres Clone ID no. 1798756
  misc_feature (1)..(894): Encodes the peptide sequence at SEQ ID NO. 478
gatctttctgataatcctttcctttgttcatattctccctttctgcttcttatttattttctttcaccttttcctttcaagatcgagagaaaaaagaatggcagaggagcatagatgccaagcgccagaaggccatcgtctttgcgtcaataactgcggctttttcggaagttcggcgacgatgaacctttgctccaaatgttacagagatctctgtctcaaggaacaggaagcttcttcgatcaaatccgctctttcctcttccccttcgtcttcatcaacggtcgtcgaatccatttctcaggttcctcttttggctctccatgaagtcaacagagaatcggcggttccggagattgcatcggcggccgaacagcgatcgcagcaacaaccgaatcggtgcatggtttgcaggaagcgggtcgggttgaccggattcagatgcaagtgcggtgttacgttttgtgggtcccacaggtaccctgagaatcacgggtgtacgttcgatttcaagaaggtcggcagagaggagatagcacgcgctaatcccctcgtcaaagcagagaagctcgagaagatttgagtagaagatgatgatgatgggaagccaagccattgggaaaatttcaaatttcatcaaacgttgataaggtcgagacacgtgtttcggaggtggtccctaccaccaagagtaaaccaattgggctggataaatatattttcttcttaaaatataaatattttataataatatttaaattatgtgcctctttagttttttttttttctcttcctcttttgctttgtaaaaaaaaaaaaagtcactttttcttttcttcttttaatcccttgtggtgaaaaaaagaaaaagaaatgtagattcctgcttcttcc

SEQ ID NO: 478 - protein, 161 aa, Gossypium hirsutum
  misc_feature (1)..(161): Ceres Clone ID no. 1798756
  misc_feature (102)..(140): Pfam Name: zf-AN1 Pfam Description: AN1-like Zinc finger
  misc_feature (14)..(37): Pfam Name: zf-A20 Pfam Description: A20-like zinc finger
  misc_feature (1)..(161): Bit score of 413.7 for HMM based on sequences of Figure 3
  misc_feature (1)..(161): Functional Homolog Of SEQ ID NO. 451
MAEEHRCQAPEGHRLCVNNCGFFGSSATMNLCSKCYRDLCLKEQEASSIKSALSSSPSSSSTVVESISQVPLLALHEVNRESAVPEIASAAEQRSQQQPNRCMVCRKRVGLTGFRCKCGVTFCGSHRYPENHGCTFDFKKVGREEIARANPLVKAEKLEKI

SEQ ID NO: 479 - DNA, 814 bp, Gossypium hirsutum
  misc_feature (1)..(814): Ceres Clone ID no. 1918424
  misc_feature (1)..(814): Encodes the peptide sequence at SEQ ID NO. 480
gttcacattcttccttccaccttttcctttcaagatcgaaagattttttctttttttaaaaatggcggaggagcatagatgccaaacgccggaaggccaccgtctttgcgttaacaactgcggctttttcggaagtccggcgacaatgaatctttgctctaaatgttatagagatttccgtcttaaagaacaacagggagctacttccatcaaatcatctctttcttcctctccttcgttttcatcttcgtcagtcgttgtcgaatccgtttctcaggttccgctgttcaatctgcctgagttcattggagaatcgccagttcctgcagtggaggttgccctggtggctgagcaacggccgcaacagcaacaaccgaatcgatgcatggtttgcaggaaacgggtcgggttgaccgggttcaggtgcaaatgcgagattacattttgcgggtcccataggtatccagagaatcacgggtgtaccttcgatttcaaggaggttgggagagaggagattgcacgcgcaaatccactggtcaaagcagagaagctggagaagatttgagatgaaagtggaaagccattggatccctcgactttcgatgaaataaaaaaaaaaaagcaaatgaaaatgatctctttaagattgcgacacgtgtttagatgtagtccccaccatgaagagaaaccaattaggctggataaaattattttcatcctaataggttttcttaaaatatatataatattttaatttatgtgcctcttttagtctttctcttttgtaaaaaaagacttttttttttttcttttc

SEQ ID NO: 480 - protein, 167 aa, Gossypium hirsutum
  misc_feature (1)..(167): Ceres Clone ID no. 1918424
  misc_feature (14)..(37): Pfam Name: zf-A20 Pfam Description: A20-like zinc finger
  misc_feature (108)..(146): Pfam Name: zf-AN1 Pfam Description: AN1-like Zinc finger
  misc_feature (1)..(167): Bit score of 384.9 for HMM based on sequences of Figure 3
  misc_feature (1)..(167): Functional Homolog Of SEQ ID NO. 451
MAEEHRCQTPEGHRLCVNNCGFFGSPATMNLCSKCYRDFRLKEQQGATSIKSSLSSSPSFSSSSVVVESVSQVPLFNLPEFIGESPVPAVEVALVAEQRPQQQQPNRCMVCRKRVGLTGFRCKCEITFCGSHRYPENHGCTFDFKEVGREEIARANPLVKAEKLEKI

SEQ ID NO: 481 - DNA, 662 bp, Gossypium hirsutum
  misc_feature (1)..(662): Ceres Clone ID no. 1929645
  misc_feature (1)..(662): Encodes the peptide sequence at SEQ ID NO. 482
ctgatctttctttctgataatcctttcctttgttcatattctccctttctgcttcttatttattttctttcaccttttcctttcaaggtacttctctttctcaccctattattttgtatttcgctgttcctctagtttgattttatgatttgaattttagattgtagatctgatctttaagaaaattaaatttaacagatcgagagaaaaaaagaatggcagaggagcatagatgccaagcgccagaaggccatcgtctttgcgtcaataactgcggctttttcggaaattcggcgacgatgaacctttgctccaaatgttacagagatctctgtctcaaggaacaggaagcttcttcgatcaaatccgctctttcctcttccccttcgtcttcgtcaacggttgtcgaatctatttctcaggttcctcttttggctctccctgaagtcaacagagaatcggcggtcccggagattgcaccggcggccgaacagctatcgcagcaacaaccgaatcggtgcatggtttgcaggaagcgggtcgggttgaccggattcagatgcaagtgcggtgttacgttttgcgggtcccacaggtaccctgagaatcacgggtgtacgttcgatttcaagaaggtcggcagagaggagatcgcacgcgct

SEQ ID NO: 482 - protein, 149 aa, Gossypium hirsutum
  misc_feature (1)..(149): Ceres Clone ID no. 1929645
  misc_feature (102)..(140): Pfam Name: zf-AN1 Pfam Description: AN1-like Zinc finger
  misc_feature (14)..(37): Pfam Name: zf-A20 Pfam Description: A20-like zinc finger
  misc_feature (1)..(149): Bit score of 357.3 for HMM based on sequences of Figure 3
  misc_feature (1)..(149): Functional Homolog Of SEQ ID NO. 451
MAEEHRCQAPEGHRLCVNNCGFFGNSATMNLCSKCYRDLCLKEQEASSIKSALSSSPSSSSTVVESISQVPLLALPEVNRESAVPEIAPAAEQLSQQQPNRCMVCRKRVGLTGFRCKCGVTFCGSHRYPENHGCTFDFKKVGREEIARA

SEQ ID NO: 483 - DNA, 878 bp, Gossypium hirsutum
  misc_feature (1)..(878): Ceres Clone ID no. 1845154
  misc_feature (1)..(878): Encodes the peptide sequence at SEQ ID NO. 484
tcgttgtttcctccttcccttctatcctctcatcccctcttccctttaataagaggcttcttttctgataattctttgctttgttcatagtttcccttcaaaattcagagatcttgcagatctgattttcaaaaataaaaaattaaaggcaaatatcaagagatttcgaagaaaaacaagaaaagatggcggaggaacatagatgccaagcgccggaaggtcaccgtctttgtgttaataactgtggtttcttaggaagtccggcgacgatgaatctttgttctaaatgttacagagatttccgtcttaaagaacaacaacaagcttcttcggctaaatcgtctatctctacctctccttcatcttcgtcaactgcagtcgaatctgtttctcaggtacctctcctgactctccctgaagtcaaaggagttccgccggttgtttcggctgtcgcgatctctccggtgacggaacagaaaccacaacagcaacagcaacaacaacaacaaccgactcggtgcacggtttgcaggaaacgggtcgggttgaccggattcaagtgcaagtgcgggattacgttttgcgggtcacacaggtacccggaaaatcatggatgcacgttcgatttcaagaagattgggcgagaggagattgcacgtgccaatcccgtggtcaaagcagagaagatcgtgaggatttgagaagaagaagatggaaagccgatcgatcctttgacttttaatgagtaaaagaaaaagagaaatagaaattgtcaaactcgttaagattgcgacacgtgtttcggtgttggtccccatacctttaaaaattgggcttggataaaaatattttatcttataaaataagtcttctatttt

SEQ ID NO: 484 - protein, 171 aa, Gossypium hirsutum
  misc_feature (1)..(171): Ceres Clone ID no. 1845154
  misc_feature (112)..(150): Pfam Name: zf-AN1 Pfam Description: AN1-like Zinc finger
  misc_feature (14)..(37): Pfam Name: zf-A20 Pfam Description: A20-like zinc finger
  misc_feature (1)..(171): Bit score of 382.7 for HMM based on sequences of Figure 3
  misc_feature (1)..(171): Functional Homolog Of SEQ ID NO. 451
MAEEHRCQAPEGHRLCVNNCGFLGSPATMNLCSKCYRDFRLKEQQQASSAKSSISTSPSSSSTAVESVSQVPLLTLPEVKGVPPVVSAVAISPVTEQKPQQQQQQQQQPTRCTVCRKRVGLTGFKCKCGITFCGSHRYPENHGCTFDFKKIGREEIARANPVVKAEKIVRI

SEQ ID NO: 485 - DNA, 912 bp, Gossypium hirsutum
  misc_feature (1)..(912): Ceres Clone ID no. 1840507
  misc_feature (1)..(912): Encodes the peptide sequence at SEQ ID NO. 486
gtactcttttcgtcgttgtttcctccttcccttttatcctctcatcccctctaccctttaataagaggcttcttttcttataattctttgctttgttcatattttcccttcaaaattcagagatcttgcagatctgattttcaaaaaccaaaaattaaaggcaaatatcaagagatttcgaagaaaaacaagaaaagatggcggaggaacatagatgccaagcgccggaaggtcaccgtctttgtgttaataactgtggtttcttaggaagtccggcgacgatgaatctttgttctaaatgttacagagatttccgacttaaagaacaacaacaagcttcttcggctaaatcgtctatctctacctctccttcatcttcgtcaacggcagtcgaatctgtttctcaggtacctctcctgactctccctgaagtcaaaggagttccgctggttgtttcggctgtcgcgatctctccggtggcggaacagaaaccacaacagcaacagcaacagcaacagcaacaacaacaacaacaacagcaaccgactcggtgcactgtttgcaagaaacgggtcgggttgaccggattcaagtgcaagtgcgggattacgttttgcgggtcacacaggtacccggaaaatcatggatgcacgttcgatttcaagaagattgggcgagagaagattgcacgtgccaatcccgtggtcaaagcagagaagatcgtgaggatttgagaagaagaagatggaaagccgattgaccctttgacttttaatgagtaaaagaaaaaaagagaaatagaaatgtcaaactcgttaagattgcgacacgtgtttcagtgttggtccccatacctttaaaaattgggcttggataaaaatattttatcttataaaataagtcttctatttt

SEQ ID NO: 486 - protein, 178 aa, Gossypium hirsutum
  misc_feature (1)..(178): Ceres Clone ID no. 1840507
  misc_feature (119)..(157): Pfam Name: zf-AN1 Pfam Description: AN1-like Zinc finger
  misc_feature (14)..(37): Pfam Name: zf-A20 Pfam Description: A20-like zinc finger
  misc_feature (1)..(178): Bit score of 368.7 for HMM based on sequences of Figure 3
  misc_feature (1)..(178): Functional Homolog Of SEQ ID NO. 451
MAEEHRCQAPEGHRLCVNNCGFLGSPATMNLCSKCYRDFRLKEQQQASSAKSSISTSPSSSSTAVESVSQVPLLTLPEVKGVPLVVSAVAISPVAEQKPQQQQQQQQQQQQQQQQPTRCTVCKKRVGLTGFKCKCGITFCGSHRYPENHGCTFDFKKIGREKIARANPVVKAEKIVRI

SEQ ID NO: 487 - DNA, 569 bp, Gossypium hirsutum
  misc_feature (1)..(569): Ceres Clone ID no. 1853430
  misc_feature (1)..(569): Encodes the peptide sequence at SEQ ID NO. 488
ccttctgattataataagatttgggtttcgttatcctctgaaactctcgtctctggtttgaaaggagattgaaaaaatatggctgaagaacatagatgtcaagcaccacagttatgtgccaacaactgtggatttttcggaagcccgacgactcaaaatctctgctctaaatgttatcgcgatcttcaacttaaagaacaacaatcttcctctgccaaacaagcctttaatcacactttcgttccttcgtcgtcttcattgccatcgtcatcatcggcccgatcttcgttttcggcatccttgccggtggaggatgaaccatcggcgggaacgaaggaaacgaaggtggtggagggggaggaagttcaggttacgccaaacagatgcttgagttgcaagaaacgcgtggggctcacggggttcaagtgcaggtgcgggatggttttttgtgggatccataggtaccctgaacaacatgcttgtacttttgatttcaaagggatgggaaaacaacaaatcgccaaagctaatcctcttgttaagggtgagaagcttcaaaaaatataaat

SEQ ID NO: 488 - protein, 162 aa, Gossypium hirsutum
  misc_feature (1)..(162): Ceres Clone ID no. 1853430
  misc_feature (10)..(34): Pfam Name: zf-A20 Pfam Description: A20-like zinc finger
  misc_feature (103)..(141): Pfam Name: zf-AN1 Pfam Description: AN1-like Zinc finger
  misc_feature (1)..(162): Bit score of 339.4 for HMM based on sequences of Figure 3
  misc_feature (1)..(162): Functional Homolog Of SEQ ID NO. 451
MAEEHRCQAPQLCANNCGFFGSPTTQNLCSKCYRDLQLKEQQSSSAKQAFNHTFVPSSSSLPSSSSARSSFSASLPVEDEPSAGTKETKVVEGEEVQVTPNRCLSCKKRVGLTGFKCRCGMVFCGIHRYPEQHACTFDFKGMGKQQIAKANPLVKGEKLQKI

SEQ ID NO: 489 - DNA, 931 bp, Gossypium hirsutum
  misc_feature (1)..(931): Ceres Clone ID no. 1853189
  misc_feature (1)..(931): Encodes the peptide sequence at SEQ ID NO. 490
atttttcctcgtttactttatcttcttctttccattctgattataataagatttgggtttcgttttcctgtgaaactctcgtctctggtaaattttccctcggttttttttgggggtttatttttatttgtcatgaacctatggctttttatttgatttctgttaaacggggggtttttttttataggtttgaaaggagattgaaaaaatatggctgaagaacatagatgtcaagcaccacagttatgtgccaacaactgtggattcttcggaagcccaacgactcaaaatctctgttctaaatgttatcgcgatcttcaacttaaagaacaacaatcttcctctgccaaacaagcctttaatcacactttagttccttcgtcgtcttcattgccatcgtcatcatcggcccgatcttcgttttcggcatccttgccggcgaaggaggaaccatcggcgggaacgaaggaaacgaaggtggtggaggaggaggaagttcaggttacgccaaacagatgcttgagttgcaagaaacgcgtggggctcacggggttcaagtgcaggtgcgggatggttttttgtgggatccataggtaccctgaacaacatgcttgtgcttttgatttcaaagggatgggaaaacaacaaatcgccaaagctaatcctcttgttaagggtgagaagcttcaaaaaatataaataaaattgactgaaggaaaaaaaagggggggggatgggtttttttccgattgtgtctgtcaaatttaagaatctgggtcatcggaaaactgatgaaatttagattgatgatgggatctagccggtcggtggccggtcaagcagtaggaagtgttttaggtggttgtcgttgttgcctataaatggtataattcacgttttcttaaattatatcgtcaatgttggttttccg

SEQ ID NO: 490 - protein, 162 aa, Gossypium hirsutum
  misc_feature (1)..(162): Ceres Clone ID no. 1853189
  misc_feature (10)..(34): Pfam Name: zf-A20 Pfam Description: A20-like zinc finger
  misc_feature (103)..(141): Pfam Name: zf-AN1 Pfam Description: AN1-like Zinc finger
  misc_feature (1)..(162): Bit score of 339.4 for HMM based on sequences of Figure 3
  misc_feature (1)..(162): Functional Homolog Of SEQ ID NO. 451
MAEEHRCQAPQLCANNCGFFGSPTTQNLCSKCYRDLQLKEQQSSSAKQAFNHTLVPSSSSLPSSSSARSSFSASLPAKEEPSAGTKETKVVEEEEVQVTPNRCLSCKKRVGLTGFKCRCGMVFCGIHRYPEQHACAFDFKGMGKQQIAKANPLVKGEKLQKI

SEQ ID NO: 491 - DNA, 662 bp, Gossypium hirsutum
  misc_feature (1)..(662): Ceres Clone ID no. 1808578
  misc_feature (1)..(662): Encodes the peptide sequence at SEQ ID NO. 492
catttcttgtttaattctctctgaaactctcaggtcaggtaattttctttttccttttagagaattgaaaaaaaaagaaaaaaaaagaagatatcagatatggcagaagaacatagatgtcaagcaccaccacaatgtgcaaacaattgtggattcttcggaaacccagcaacccaaaatctttgttctcaatgttaccgccatctccagcaccttaaagaacaaggatcttcctctgctgccaaacaggcttttaatcaagcccccctcccttccttttcttcttcatcatcgtcgttttcggtttccttggcggtgaagcatgaaccgttggcggaaaccaaggaagaggtggtccaagcggaggttcaggtccacgttcaagttcgacctaacagatgcatgacttgcaggaagcgcgtggggctgacggggttcaagtgcaggtgtgggatggtgttttgtggcacccataggtaccctgaaaatcatggttgtagtttcgatttcaaagggatgggaaaacaacagattgccaaatcgaatccggttgtcaaaggcgagaagcttcagaaaatctaaaggaaaaaggggtattgtacgaatgatgttgcgttagtatgtgatttgaacatcaatttattaattaattttgggttttt

SEQ ID NO: 492 - protein, 160 aa, Gossypium hirsutum
  misc_feature (1)..(160): Ceres Clone ID no. 1808578
  misc_feature (101)..(139): Pfam Name: zf-AN1 Pfam Description: AN1-like Zinc finger
  misc_feature (10)..(34): Pfam Name: zf-A20 Pfam Description: A20-like zinc finger
  misc_feature (1)..(160): Bit score of 305.6 for HMM based on sequences of Figure 3
  misc_feature (1)..(160): Functional Homolog Of SEQ ID NO. 451
MAEEHRCQAPPQCANNCGFFGNPATQNLCSQCYRHLQHLKEQGSSSAAKQAFNQAPLPSFSSSSSSFSVSLAVKHEPLAETKEEVVQAEVQVHVQVRPNRCMTCRKRVGLTGFKCRCGMVFCGTHRYPENHGCSFDFKGMGKQQIAKSNPVVKGEKLQKI

SEQ ID NO: 493 - DNA, 1118 bp, Gossypium hirsutum
  misc_feature (1)..(1118): Ceres Clone ID no. 1857508
  misc_feature (1)..(1118): Encodes the peptide sequence at SEQ ID NO. 494
aaaaccaaaccaaaacctttggtttggtttttagttttgttaattatttttcgagtttcggtttcgtttttgttttcccatttgttgtattctattttcttctcctgttgttctccaccaagaaaggaatcagggttcctctgctgtttctataaatcatttctcaattccctttcttttttttagtcagattctggatttggaaaaaaaaatatcttctctgtcttcggatttcctcacgttttcttaaatcatcgatcaacgccgacctagaacaagaataaaacgaggaacaaacaacctctgattgtcgaattaacgagaaaccaaaagcaaacgcataaagaaatcatgggttctgaacagaatgaaggaactagcttccctccatcggagccaaaactttgtgccaacggctgtgggtttttcggcacggcggcgaatatgaacctctgttccaagtgttaccgggacctccgtgccggggaggagcaagctgccaaggcgaaagctgccatggagaaatccctcagcgttaatacgaagcaggaagatgtcgttgacgagactgtgaagcctgttcttgagcttcctcatgtgggttcctcatcgacggtggtcgagaaacaaccggctgctattgtctccgatgataaaccggcggaacccaaggcggcgaacaggtgctttatctgcagaaagaaggttggattgaccgggttcaagtgcaagtgcgggagtacattctgcggcgagcatcgttacgcggaaaaacatgattgctcctttgatttcaagggtactggacgtgatgcgattgccaaagcaaatcccgtcgttaaagctgacaaggttgagaggatttaaaaaagtattagtgggttgttccacttggttctttgaatggatttcccttttttttttgttctctatcggggatcagttaggtttaggataacaggaaaaattgcggggtgttttgatgtcgttgctagtgtcggggcagctttgtttgattccataataaaaaatggtatcaatgaatgtttagctttcagtttttacttggaatgtttctggctttgatctttcattatatccatatttcagtttatgtt

SEQ ID NO: 494 - protein, 171 aa, Gossypium hirsutum
  misc_feature (1)..(171): Ceres Clone ID no. 1857508
  misc_feature (112)..(150): Pfam Name: zf-AN1 Pfam Description: AN1-like Zinc finger
  misc_feature (16)..(40): Pfam Name: zf-A20 Pfam Description: A20-like zinc finger
  misc_feature (1)..(171): Bit score of 253.3 for HMM based on sequences of Figure 3
  misc_feature (1)..(171): Functional Homolog Of SEQ ID NO. 451
MGSEQNEGTSFPPSEPKLCANGCGFFGTAANMNLCSKCYRDLRAGEEQAAKAKAAMEKSLSVNTKQEDVVDETVKPVLELPHVGSSSTVVEKQPAAIVSDDKPAEPKAANRCFICRKKVGLTGFKCKCGSTFCGEHRYAEKHDCSFDFKGTGRDAIAKANPVVKADKVERI

SEQ ID NO: 495 - DNA, 856 bp, Gossypium hirsutum
  misc_feature (1)..(856): Ceres Clone ID no. 1946245
  misc_feature (1)..(856): Encodes the peptide sequence at SEQ ID NO. 496
aatttagcttttgaccctttctaaaagaatccatcaacaaaaaaatccttaattttgttcatctttgattgtagaaaaatcaaaagcaaaaagcttgccgaattagaaaaagaaattatgggttctgaacagaatgaaggaacaagctttccaccatcggagccaaagctttgtgccaacggttgtgggtttttcgggacggcggcgaatatgaatttatgttcaaagtgttaccgggacctccgtgttggggaggagcaagcggcgaaggcgaaagctgttatggagaaatctctcagtatcaaaacgaagcatgaacctgtcgttgtggagacttttaagcctcatgtgggttcttcgtctacatcgattgagcaacaacaaccggctgttgttgccgttaatcaacaaccggaaccaaaggcggcgaacaggtgttttatttgtaggaaaaaggttgggttaactgggtttaagtgcaggtgcgagaatacattctgtggggagcatcggtacccagaaaaacacgagtgttcatttgatttcaagggtgttggacgtgatgccattgctaaggcaaatcccgttgttaaagctgataaggtggagaggttctgaaaggtgggggagttgtttgttggatgaatgtgtttcttgccttttcttacttcctatctcggggttatcgagagagcagttagatttagggtcaatggaaatattgtggggtgatttactgatttatgttgttgctggtgtttttgttggggttgtgggatatgatttgggagggggagggggatgttttaagggtgaatgcaaaatggatcaatgaatgtttttagttttcattttt

SEQ ID NO: 496 - protein, 166 aa, Gossypium hirsutum
  misc_feature (1)..(166): Ceres Clone ID no. 1946245
  misc_feature (107)..(144): Pfam Name: zf-AN1 Pfam Description: AN1-like Zinc finger
  misc_feature (16)..(40): Pfam Name: zf-A20 Pfam Description: A20-like zinc finger
  misc_feature (1)..(166): Bit score of 255.0 for HMM based on sequences of Figure 3
  misc_feature (1)..(166): Functional Homolog Of SEQ ID NO. 451
MGSEQNEGTSFPPSEPKLCANGCGFFGTAANMNLCSKCYRDLRVGEEQAAKAKAVMEKSLSIKTKHEPVVVETFKPHVGSSSTSIEQQQPAVVAVNQQPEPKAANRCFICRKKVGLTGFKCRCENTFCGEHRYPEKHECSFDFKGVGRDAIAKANPVVKADKVERF

SEQ ID NO: 497 - DNA, 1023 bp, Gossypium hirsutum
  misc_feature (1)..(1023): Ceres Clone ID no. 1974721
  misc_feature (1)..(1023): Encodes the peptide sequence at SEQ ID NO. 498
agagagtctccgtttcgagtttggttttttaatatttgtttcactttttcagtttcgtccttgtgtctcccctcctttcggtttctctccgccccccccccaataaaaacgaaattcagggaattaaattccctataaaatcgtttctcgtaaatttccttttcgttttaaatcaaacccgatttcctggtttctttttcttcatcgatcgtcgccggcggaaaaacaagaaaaatcaaaagcaaaaagcttgcagaattagaaaaaaaattatgggttctgaacagaatgaaggaacaagctttccaccatcggagccaaagctttgtgccaacggttgtgggtttttcgggacggcagcgaatatgaatttatgttcaaagtgttaccgggacctccgtgttggggaggagcaagcggcgaaggcgaaagctgttatggagaaatctctcagtatcaaaacgaagcatgaacctgtcgttgtggagacttttaagcctcatgtgggttcttcgtctacatcgattgagcaacaacaaccggctgttgttgccgttaatcaacaaccggaaccaaaggcggcgaacaggtgttttatttgtaggaaaaaggttgggttaactgggtttaagtgcaggtgcgagaatacattctgtggggagcatcggtacccagaaaaacacgagtgttcatttgatttcaagggtattggacgtgatgccattgctaaggcaaatcccgttgttaaagctgataaggtggagaggttctgaaaggtgggggagttgtttgttggatgaatgtgtttcttcccttttcttactgcctatctcggggttatcgagagagcagttagatttagggtcaatggaaatattgtggggtgatttactgatttatgttgttactggtgtttttgttggggttggggttggggttgtgggatatgatttgggagggggagggggatgttttaagggtgattgaaaaatggatcaatgaatgtttctagttttcattttt

SEQ ID NO: 498 - protein, 166 aa, Gossypium hirsutum
  misc_feature (1)..(166): Ceres Clone ID no. 1974721
  misc_feature (107)..(145): Pfam Name: zf-AN1 Pfam Description: AN1-like Zinc finger
  misc_feature (16)..(40): Pfam Name: zf-A20 Pfam Description: A20-like zinc finger
  misc_feature (1)..(166): Bit score of 254.8 for HMM based on sequences of Figure 3
  misc_feature (1)..(166): Functional Homolog Of SEQ ID NO. 451
MGSEQNEGTSFPPSEPKLCANGCGFFGTAANMNLCSKCYRDLRVGEEQAAKAKAVMEKSLSIKTKHEPVVVETFKPHVGSSSTSIEQQQPAVVAVNQQPEPKAANRCFICRKKVGLTGFKCRCENTFCGEHRYPEKHECSFDFKGIGRDAIAKANPVVKADKVERF

SEQ ID NO: 499 - DNA, 684 bp, Gossypium hirsutum
  misc_feature (1)..(684): Ceres Clone ID no. 1940441
  misc_feature (1)..(684): Encodes the peptide sequence at SEQ ID NO. 500
cttttgaaccaaacaccccccctaatcagaaccctaactttttttttcttctaatctttgattgtagaaaccaaaagcaaacgcgtaaagaaatcatgggttctgaacagaatgaaggaactagcttccctccatcggcgccaaaactttgtgccaacggctgtgggtttttcggcacggcggcgaatatgaacctctgttccaagtgttaccgtgacctccgtgccggggaggagcaagctgccaaggcgaaagctgccatggagaaatccctcagcgttaatacgaagcaggaagatgtcgttgacgagactgtgaagcctgttcttgagcttcctcatgtgggttcctcatcgacggtggtcgagatacaaccggctgctattgtctccgatgataaaccggcggaatccaaggcggcgaacaggtgctttatctgcagaaagaaggttggattgaccgggttcaagtgcaagtgcggaagtacattctgcggcgagcatcgttacccggaaaaacatgagtgctcctttgatttcaagggtactggacgtgatgcgattgccaaagcaaatcccgtcgttaaagctgacaaggttgagaggatttaaagaagtattagtgggttttccacttggttctttgaatggatttcccttttcttttctttttttgtttctctat

SEQ ID NO: 500 - protein, 171 aa, Gossypium hirsutum
  misc_feature (1)..(171): Ceres Clone ID no. 1940441
  misc_feature (112)..(150): Pfam Name: zf-AN1 Pfam Description: AN1-like Zinc finger
  misc_feature (16)..(40): Pfam Name: zf-A20 Pfam Description: A20-like zinc finger
  misc_feature (1)..(171): Bit score of 258.2 for HMM based on sequences of Figure 3
  misc_feature (1)..(171): Functional Homolog Of SEQ ID NO. 451
MGSEQNEGTSFPPSAPKLCANGCGFFGTAANMNLCSKCYRDLRAGEEQAAKAKAAMEKSLSVNTKQEDVVDETVKPVLELPHVGSSSTVVEIQPAAIVSDDKPAESKAANRCFICRKKVGLTGFKCKCGSTFCGEHRYPEKHECSFDFKGTGRDAIAKANPVVKADKVERI

SEQ ID NO: 501 - DNA, 695 bp, Gossypium hirsutum
  misc_feature (1)..(695): Ceres Clone ID no. 1834813
  misc_feature (1)..(695): Encodes the peptide sequence at SEQ ID NO. 502
gaactttggctgtttcagattttccgtgaaaatcaagaaggaaaaaaaacccttaaaatcaaaaccctaatcctatttttttttcctttttgattgtggaaaacaaagcaagccctcaactggacaacatggggtctgaacagaatcaaggaaccagctttcccccgtcggagccgaagctttgcgctaacggttgcgggtttttcggaacggcggcgaacatgaacctctgctccaagtgttaccgggacctccgtgctggggaggagcaagcggcgaaggcgaaagctgccatggagaaatcccttagcgtcaaaccgaaagaagatgtcgttgtggagacgtttaagcccgttgagaagctgcctcatgcgggttcatcatcagcggcggttgagcaaccggccgtggctctctccggcgatgaacagcccgagccaaaattgtcgagccggtgctttatctgcagaaagaaggttggattgactgggtttaagtgccgatgcgggagtgcgttctgtggggagcaccggtacccagaaaaacacgagtgctccttcgatttcaagggcactggacgcgatgcgattgccagtgcaaatcccgtcatcaaagctgacaaattggagaggttttgaaaggtggggagcttggagtcagtttgcctgaatcgtgttcttcaatgggtttgcctt

SEQ ID NO: 502 - protein, 169 aa, Gossypium hirsutum
  misc_feature (1)..(169): Ceres Clone ID no. 1834813
  misc_feature (110)..(148): Pfam Name: zf-AN1 Pfam Description: AN1-like Zinc finger
  misc_feature (16)..(40): Pfam Name: zf-A20 Pfam Description: A20-like zinc finger
  misc_feature (1)..(169): Bit score of 242.1 for HMM based on sequences of Figure 3
  misc_feature (1)..(169): Functional Homolog Of SEQ ID NO. 451
MGSEQNQGTSFPPSEPKLCANGCGFFGTAANMNLCSKCYRDLRAGEEQAAKAKAAMEKSLSVKPKEDVVVETFKPVEKLPHAGSSSAAVEQPAVALSGDEQPEPKLSSRCFICRKKVGLTGFKCRCGSAFCGEHRYPEKHECSFDFKGTGRDAIASANPVIKADKLERF

SEQ ID NO: 503 - DNA, 962 bp, Gossypium hirsutum
  misc_feature (1)..(962): Ceres Clone ID no. 1848383
  misc_feature (1)..(962): Encodes the peptide sequence at SEQ ID NO. 504
aaatcccaaaaaataaatcataccacccaaaattttctctcttctcttctcgtctcggtttgcataaatctcttcggtttaggaactgccggggttccattttgtcatcaagatcggccaaattaaaatttcaggcgatcggagaagatggactctcatgatgaaactgggtgccaagctccagaaggtcccatcctgtgcgtcaacaactgcggcttctttggaagtgcggctaccatgaatatgtgctccaagtgtcacaaggcaatgattctgaagcaggaacaggtgcaacttgcagcagcatccattggaagcattgttaatggctgctctagtggtagcagtaaggaaccagctgtggctgctgctttggatgtacaacctgtaaatattgagtcaaagattgtgtcagcagagccatccattgatccttctagaacaaccgtcagtgagttggagacaaaaaagggtcctaataggtgctcaacatgccataagcgtgttggtttgacaggatttaactgcaggtgtggaaacctcttctgtgcagctcatcgttactcagacaaacacgagtgcccttttgattaccaggccgctgctcgtaatgctatttctaaagccaaccctgtagtcagagctgagaaactggataaaatctaagggtcctggatgaaggtgaagatttgtgtagtcaaatatgatgattctccctctattccttgtgtattgggcccattgtagtgaaggtttataagttgggtgcttgtctccccatgttagggaagacatggttgcagtgtaagtcttatattccatgtcaatcggttggcattacaatggctcatgtttgtaagactttgtttgtgctggtttgatggacaacgatacgattgaacaccatggtaatgcttctttgtggtatacacatttctttatactagtagctcggctatatc

SEQ ID NO: 504 - protein, 172 aa, Gossypium hirsutum
  misc_feature (1)..(172): Ceres Clone ID no. 1848383
  misc_feature (15)..(39): Pfam Name: zf-A20 Pfam Description: A20-like zinc finger
  misc_feature (113)..(152): Pfam Name: zf-AN1 Pfam Description: AN1-like Zinc finger
  misc_feature (1)..(172): Bit score of 306.8 for HMM based on sequences of Figure 3
  misc_feature (1)..(172): Functional Homolog Of SEQ ID NO. 451
MDSHDETGCQAPEGPILCVNNCGFFGSAATMNMCSKCHKAMILKQEQVQLAAASIGSIVNGCSSGSSKEPAVAAALDVQPVNIESKIVSAEPSIDPSRTTVSELETKKGPNRCSTCHKRVGLTGFNCRCGNLFCAAHRYSDKHECPFDYQAAARNAISKANPVVRAEKLDKI

SEQ ID NO: 505 - DNA, 936 bp, Gossypium hirsutum
  misc_feature (1)..(936): Ceres Clone ID no. 1895219
  misc_feature (1)..(936): Encodes the peptide sequence at SEQ ID NO. 506
aaaaaaaaatccaaaaagaaaaatcatacgatcaaagatcgtctttctcgtctggatttctccgattatcatacataaaactcttcgattaagagatcactgttttcgattttgttagacaagatcggccgattagaatttcaggggattagagaagatggagtctcacgatgagacagggtgccaagccccagaaggccccattctttgtatcaacaactgtggcttcttcggcagtgcagctaccatgaatatgtgctccaagtgtcacaaagcaatgatcctgaagcaggaacaggcgcaacttgcagcatcatcaatcggaagcatcgtgaatggcagctcaactgggaacagtaaggaaccagccgtggctactgctttggatgtacaatctggaaacgccgacaccaaaatggtctcaacagagctacccattgacccatccggaaagacttcatgtgggatgaaaacgaaagagggtcctaacaggtgtaccaaatgctgtaaacgtgttggtctgacaggatttaactgcaggtgtggaaacctcttctgtgcagctcatcgttactccgacaaacatgactgccctttcgattaccgagctgctgctcgcgatgctattgctaaagccaacccagttgttcgggcagagaagctcgataaaatctgagaacaacccggatcaagatgaagatatgtggatggtttatgtaagttggttacttgtctcatcaagtgtccccttgattgatattaaatgttgggagtccatcatagggaatgttgggagtccatcatagggagggacatgatttgcattgtaagtctatattttcccctgtttgtaagtgtttttatttgtgcttgtttgatggacattgatatgatcaacttgtaatgcttcttctttgtggtatgcattttttttct

SEQ ID NO: 506 - protein, 172 aa, Gossypium hirsutum
  misc_feature (1)..(172): Ceres Clone ID no. 1895219
  misc_feature (15)..(39): Pfam Name: zf-A20 Pfam Description: A20-like zinc finger
  misc_feature (113)..(151): Pfam Name: zf-AN1 Pfam Description: AN1-like Zinc finger
  misc_feature (1)..(172): Bit score of 305.6 for HMM based on sequences of Figure 3
  misc_feature (1)..(172): Functional Homolog Of SEQ ID NO. 451
MESHDETGCQAPEGPILCINNCGFFGSAATMNMCSKCHKAMILKQEQAQLAASSIGSIVNGSSTGNSKEPAVATALDVQSGNADTKMVSTELPIDPSGKTSCGMKTKEGPNRCTKCCKRVGLTGFNCRCGNLFCAAHRYSDKHDCPFDYRAAARDAIAKANPVVRAEKLDKI

SEQ ID NO: 507 - DNA, 906 bp, Gossypium hirsutum
  misc_feature (1)..(906): Ceres Clone ID no. 1866608
  misc_feature (1)..(906): Encodes the peptide sequence at SEQ ID NO. 508
aaaataaaatccaaaaagaaaaatcatacgatcaaagatcgtctttctcgtctggatttctccgattatcatacataaaactcttcgattaagtgatcactgggttcgattttgttagacaagatcggccgattaggatttcagtttcctagcaggggattagagaagatggagtctcacgatgagacagggtgccaagccccagaaggccccattctttgtatcaacaactgtggcttcttcggcagtgcagctaccatgaatatgtgctccaagtgtcacaaatcgatgatcctgaagcaggaacaggcgcaacttgcagcatcatcaatcggaagcatcgtgaatggcagctcaactgggaacggtaaggaaccagccgtggctactgctttggatgtacaatctggaaacgccgacaccaaaatggtctcaacagagctacccattgacccatccggaacgacttcatgtgggatgaaaatgaaagagggtcctaacaggtgtaccaaatgctgtaaacgtgttggtttgacaggatttaactgcaggtgtggaaacctcttctgtgcagctcatcgttactccgacaaacatgactgccctttcgattaccgagctgctgctcgcaatgctattgctaaagccaacccagttgttcgggcagagaagctcgataaaatctgagaacaacccgggtcaagatgaagatatgtggatggtttatgtaagttggttacttgtctcatcaagtgtccccttgattgatattaaatgttgggagtccatcatagggagggacatgatttgcattgtaagtctatattttcccgtttgtaagtgtttttatttgtgcttgtttgatggacattgatatgatcaacttgtaatgcttcttctttgtgg

SEQ ID NO: 508 - protein, 172 aa, Gossypium hirsutum
  misc_feature (1)..(172): Ceres Clone ID no. 1866608
  misc_feature (15)..(39): Pfam Name: zf-A20 Pfam Description: A20-like zinc finger
  misc_feature (113)..(151): Pfam Name: zf-AN1 Pfam Description: AN1-like Zinc finger
  misc_feature (1)..(172): Bit score of 302.9 for HMM based on sequences of Figure 3
  misc_feature (1)..(172): Functional Homolog Of SEQ ID NO. 451
MESHDETGCQAPEGPILCINNCGFFGSAATMNMCSKCHKSMILKQEQAQLAASSIGSIVNGSSTGNGKEPAVATALDVQSGNADTKMVSTELPIDPSGTTSCGMKMKEGPNRCTKCCKRVGLTGFNCRCGNLFCAAHRYSDKHDCPFDYRAAARNAIAKANPVVRAEKLDKI

SEQ ID NO: 509 - DNA, 516 bp, Populus trichocarpa
  misc_feature (1)..(516): Ceres Annot ID no. 1481252
  misc_feature (1)..(516): Encodes the peptide sequence at SEQ ID NO. 510
atggagtctcatgatgagactggatgccaggctccagagggccccatcctctgcatcaataactgcggcttctttggaagtgctgctacaatgaacatgtgctccaagtgccacaaggacataatcctgaagcagcaacaggctcaattggcagcatcatccatcgagagcattgtgaatggcaactctagcggaaatggaaaagaacctgtggttgctgttgctgttgatgtacagtctgcaccagtagaggtgaaaatcatctctacagaaccatcaagtgcaacttcaagcaagccttctgagatgaaggcaaaagagggacccagtaggtgtacctcttgccgaaagcgtgtcggtttaacagggttcagttgtagatgtggaaacctgttctgtgcagttcatcgctactctgataagcataactgtcgctttgattatcggaatgctgctcgggatgctattgctaaagccaacccagttgtcagggcagagaagctggataaaatctaa

SEQ ID NO: 510 - protein, 171 aa, Populus trichocarpa
  misc_feature (1)..(171): Ceres Annot ID no. 1481252
  misc_feature (15)..(39): Pfam Name: zf-A20 Pfam Description: A20-like zinc finger
  misc_feature (112)..(151): Pfam Name: zf-AN1 Pfam Description: AN1-like Zinc finger
  misc_feature (1)..(171): Bit score of 332.6 for HMM based on sequences of Figure 3
  misc_feature (1)..(171): Functional Homolog Of SEQ ID NO. 451
MESHDETGCQAPEGPILCINNCGFFGSAATMNMCSKCHKDIILKQQQAQLAASSIESIVNGNSSGNGKEPVVAVAVDVQSAPVEVKIISTEPSSATSSKPSEMKAKEGPSRCTSCRKRVGLTGFSCRCGNLFCAVHRYSDKHNCRFDYRNAARDAIAKANPVVRAEKLDKI

SEQ ID NO: 511 - DNA, 513 bp, Populus trichocarpa
  misc_feature (1)..(513): Ceres Annot ID no. 1474904
  misc_feature (1)..(513): Encodes the peptide sequence at SEQ ID NO. 512
atggagtctcatgatgagactggatgccaagctccagagggccccatcctctgcattaacaactgtggcttctttggaagtgctgctaccatgaacatgtgttccaagtgccacaaggacatcatcctgaaccagcaacaagcccaactggcagcatcatccattgaaagcattgtgaatggaaactctagcgggaatggaaaagaacctgtggttgctggtgccgttgatgtacaagctgcacctgtagaggtgaaaatcatctccacagaaccatccattgcttcaagcaagccttctgagatgaaggcaaaagagggacctagtaggtgtaccgcttgccgaaagcgtgttggtttaacaggtttcggttgtagatgtggaaacctgttctgtgcaattcatcgttactctgacaagcatgactgtccctttgattatcggactgctgctcgtgatgctattgctaaagccaacccagttgtcaaggcagagaagcttgataagatctaa

SEQ ID NO: 512 - protein, 170 aa, Populus trichocarpa
  misc_feature (1)..(170): Ceres Annot ID no. 1474904
  misc_feature (15)..(39): Pfam Name: zf-A20 Pfam Description: A20-like zinc finger
  misc_feature (111)..(150): Pfam Name: zf-AN1 Pfam Description: AN1-like Zinc finger
  misc_feature (1)..(170): Bit score of 335.2 for HMM based on sequences of Figure 3
  misc_feature (1)..(170): Functional Homolog Of SEQ ID NO. 451
MESHDETGCQAPEGPILCINNCGFFGSAATMNMCSKCHKDIILNQQQAQLAASSIESIVNGNSSGNGKEPVVAGAVDVQAAPVEVKIISTEPSIASSKPSEMKAKEGPSRCTACRKRVGLTGFGCRCGNLFCAIHRYSDKHDCPFDYRTAARDAIAKANPVVKAEKLDKI

SEQ ID NO: 513 - DNA, 504 bp, Populus trichocarpa
  misc_feature (1)..(504): Ceres Annot ID no. 1450673
  misc_feature (1)..(504): Encodes the peptide sequence at SEQ ID NO. 514
atggcagaagaacaacacagatgccaagaacaacgactctgcgtaaacaactgcggcttttatgggagccaagcaacagaaaatctttgttccaagtgttaccgtgatcttcatcaatcacagcccttgaatcatcagctgctaaacccatcatcatcatcggctgcttctgtttcctcctttgcatccccagccgttgatgttctaaaagtcaacaccaaccagaaagctcctgttgtggtggtgggagatgataaaaaagatgaggtaaaggcaggagagcctgcggctgggaagcagcagcagcataagccaaataggtgcttgacgtgtaggaggcgcgtggggttgacggggttcaagtgcaggtgtggtatggtgttttgtggaacacataggtacccggaacagcatgattgcgaatttgattttaagagtttagggaaacaacagattgctaaggctaatcccgttgttaagggagagaaactccaaaaaatttaa

SEQ ID NO: 514 - protein, 167 aa, Populus trichocarpa
  misc_feature (1)..(167): Ceres Annot ID no. 1450673
  misc_feature (108)..(146): Pfam Name: zf-AN1 Pfam Description: AN1-like Zinc finger
  misc_feature (12)..(35): Pfam Name: zf-A20 Pfam Description: A20-like zinc finger
  misc_feature (1)..(167): Bit score of 308.7 for HMM based on sequences of Figure 3
  misc_feature (1)..(167): Functional Homolog Of SEQ ID NO. 451
MAEEQHRCQEQRLCVNNCGFYGSQATENLCSKCYRDLHQSQPLNHQLLNPSSSSAASVSSFASPAVDVLKVNTNQKAPVVVVGDDKKDEVKAGEPAAGKQQQHKPNRCLTCRRRVGLTGFKCRCGMVFCGTHRYPEQHDCEFDFKSLGKQQIAKANPVVKGEKLQKI

SEQ ID NO: 515 - DNA, 519 bp, Populus trichocarpa
  misc_feature (1)..(519): Ceres Annot ID no. 1437933
  misc_feature (1)..(519): Encodes the peptide sequence at SEQ ID NO. 516
atggaccatgacgagacaggatgccaagctcctccagaaggtcctattttgtgtactaacaattgtggcttctttggaagtgcagctactatgaacatgtgttcaaagtgccacaagggtatgctgttaaaacaggagcaggctaatcttgctgcgtcatctattggaagtattgtgaatggatcatcaagcagcaatgtttttgaacctgttattgctgacatcattgatgtccaaaacaatgcagtggagcctaagaccatcactgtgcagccatcctgtgcttcaggctcaggggagagggttgaggcaaagccgaaggagggtccaaaccggtgcacctcttgcaagaaaagagttggtttaacagggttcaagtgtcgatgtggtagcctcttttgtgcatctcatcgctactcagataaacatgactgcccatttgattatcgttctgctgcccgtgaagcaatagcaaaagccaaccctgttgtcaaggcagagaagcttgataaaatctaa

SEQ ID NO: 516 - protein, 172 aa, Populus trichocarpa
  misc_feature (1)..(172): Ceres Annot ID no. 1437933
  misc_feature (113)..(152): Pfam Name: zf-AN1 Pfam Description: AN1-like Zinc finger
  misc_feature (15)..(39): Pfam Name: zf-A20 Pfam Description: A20-like zinc finger
  misc_feature (1)..(172): Bit score of 314.0 for HMM based on sequences of Figure 3
  misc_feature (1)..(172): Functional Homolog Of SEQ ID NO. 451
MDHDETGCQAPPEGPILCTNNCGFFGSAATMNMCSKCHKGMLLKQEQANLAASSIGSIVNGSSSSNVFEPVIADIIDVQNNAVEPKTITVQPSCASGSGERVEAKPKEGPNRCTSCKKRVGLTGFKCRCGSLFCASHRYSDKHDCPFDYRSAAREAIAKANPVVKAEKLDKI

SEQ ID NO: 517 - DNA, 519 bp, Populus trichocarpa
  misc_feature (1)..(519): Ceres Annot ID no. 1448174
  misc_feature (1)..(519): Encodes the peptide sequence at SEQ ID NO. 518
atggaccgtgacgagacaggatgccaagctcctccagaacgtcctattttgtgcattaacaattgtggcttctttggaagtgcagctactatgaacatgtgttcaaagtgccacaaggatatgctgttaaaacaggagcagactaagcttgctgcatcatcaattggaagtattgtgaatggatcggcaagcagcaatgtgaatgaacctgttattgctgacaccattaatgtccaaatcaatgcagtggagcctaagaccatcactgtgcagccatcctgtgcttcagtttcaggggagagagttgaggcaaagccgaaggaggggccaagccggtgcacctcttgcaagaaaagagttggtttaacagggtttaagtgtcgatgtggtgacctcttttgtgcatctcatcgctactcagacaaacatgactgcccatttgattaccgtactgctgcccgtgaagcaatagcaaaagccaatcctgttgtcaaggcagagaagcttgataaaatctga

SEQ ID NO: 518 - protein, 172 aa, Populus trichocarpa
  misc_feature (1)..(172): Ceres Annot ID no. 1448174
  misc_feature (113)..(152): Pfam Name: zf-AN1 Pfam Description: AN1-like Zinc finger
  misc_feature (15)..(39): Pfam Name: zf-A20 Pfam Description: A20-like zinc finger
  misc_feature (1)..(172): Bit score of 306.4 for HMM based on sequences of Figure 3
  misc_feature (1)..(172): Functional Homolog Of SEQ ID NO. 451
MDRDETGCQAPPERPILCINNCGFFGSAATMNMCSKCHKDMLLKQEQTKLAASSIGSIVNGSASSNVNEPVIADTINVQINAVEPKTITVQPSCASVSGERVEAKPKEGPSRCTSCKKRVGLTGFKCRCGDLFCASHRYSDKHDCPFDYRTAAREAIAKANPVVKAEKLDKI

SEQ ID NO: 519 - DNA, 525 bp, Populus trichocarpa
  misc_feature (1)..(525): Ceres Annot ID no. 1447323
  misc_feature (1)..(525): Encodes the peptide sequence at SEQ ID NO. 520
atgggttctgagcaaaacgatggcacaagcttcccaccagcagagccaaagctttgtgttaatgggtgtggattttttggtacggctgcaaacatgaacctttgctccaagtgttaccgtgaccttcgtgccgaagaagagcaagctgcctctgccaaggctgccatggaaaagacactgaatatcaatccaaaacaaaatattgattctaaggttgttgtcgatgcccctcaagttgtggtggctaattccgtgcagtcagttgtgtctgctgaagcttcttcgtcagcagaaactgttgttgctggtggtgatcaggtgccatcaaagccggcaaataggtgctttagctgcagtaagaaggttggtttgacaggattccagtgcaagtgcggtggcacttactgcgggactcataggtacgcagagaatcacgagtgcctctttgatttcaaaggtgctggccgtgatgcaatcgcgaaggcaaatcctgtgattaaggctaataaggtggagaggttctga

SEQ ID NO: 520 - protein, 174 aa, Populus trichocarpa
  misc_feature (1)..(174): Ceres Annot ID no. 1447323
  misc_feature (115)..(153): Pfam Name: zf-AN1 Pfam Description: AN1-like Zinc finger
  misc_feature (16)..(40): Pfam Name: zf-A20 Pfam Description: A20-like zinc finger
  misc_feature (1)..(174): Bit score of 232.0 for HMM based on sequences of Figure 3
  misc_feature (1)..(174): Functional Homolog Of SEQ ID NO. 451
MGSEQNDGTSFPPAEPKLCVNGCGFFGTAANMNLCSKCYRDLRAEEEQAASAKAAMEKTLNINPKQNIDSKVVVDAPQVVVANSVQSVVSAEASSSAETVVAGGDQVPSKPANRCFSCSKKVGLTGFQCKCGGTYCGTHRYAENHECLFDFKGAGRDAIAKANPVIKANKVERF

SEQ ID NO: 521 - DNA, 471 bp, Populus trichocarpa
  misc_feature (1)..(471): Ceres Annot ID no. 1456578
  misc_feature (1)..(471): Encodes the peptide sequence at SEQ ID NO. 522
atggagcaagaatcccaaaagagaaagctagaagacagcagcagtaacgaggcacaaaacacgccaattctttgtgtgaataactgtggtttttttggaagccccaacactaataatctctgctctaaatgttacaaagaattccttctaacccaacaagacacaactacaacaacaattgatgttccagttcatgttgccgaaaacagtgcagcagcagcagcagaagttgaagggcaacaagaaggaggtgaagaggagaagcggccggtggtggtggcaaacaggtgcaacttctgcaggaaaaaagtgggcttgacagggttcaagtgccgttgtggatacactttctgttcgcagcacagatattcggacaagcataactgtgtgttcgattacaagagtgctggacaggatgctattgctaaagccaatcctgttgtcaaggcagataagattgataagatatga

SEQ ID NO: 522 - protein, 156 aa, Populus trichocarpa
  misc_feature (1)..(156): Ceres Annot ID no. 1456578
  misc_feature (22)..(46): Pfam Name: zf-A20 Pfam Description: A20-like zinc finger
  misc_feature (97)..(136): Pfam Name: zf-AN1 Pfam Description: AN1-like Zinc finger
  misc_feature (1)..(156): Bit score of 241.6 for HMM based on sequences of Figure 3
  misc_feature (1)..(156): Functional Homolog Of SEQ ID NO. 451
MEQESQKRKLEDSSSNEAQNTPILCVNNCGFFGSPNTNNLCSKCYKEFLLTQQDTTTTTIDVPVHVAENSAAAAAEVEGQQEGGEEEKRPVVVANRCNFCRKKVGLTGFKCRCGYTFCSQHRYSDKHNCVFDYKSAGQDAIAKANPVVKADKIDKI

SEQ ID NO: 523 - DNA, 516 bp, Populus trichocarpa
  misc_feature (1)..(516): Ceres Annot ID no. 1491680
  misc_feature (1)..(516): Encodes the peptide sequence at SEQ ID NO. 524
atgggttctgagcaaaacgaaggtacaagctttccatcgtcacagccacagctttgtgctaatggatgtggtttttttggcacggctgcaaacatgaacctttgctccaagtgttaccgtgaccttcgtgctgaagaagagcaagctgcctttgctaaggctgctatggaaaagacgctaaacatgaagtcacaacaacatattgactctagggttgctgttgatgcccctcaagttgcggtggctaattccatgcaatccgctgaagcctcttcttcggcagaaactgctgttgctgctggcgatcaggtgtcatcgaagccggcaaataggtgcttcagctgcaataagaaggttggcttgacaggattcatgtgcaaatgcggtggcacatactgtgggactcataggtactctgagaatcacgagtgctccttcgatttcaagggtgctggccgtaatgctattgccaaggcgaatcctgtgattaaggctgataaggtggggaggttctga

SEQ ID NO: 524 - protein, 171 aa, Populus trichocarpa
  misc_feature (1)..(171): Ceres Annot ID no. 1491680
  misc_feature (16)..(40): Pfam Name: zf-A20 Pfam Description: A20-like zinc finger
  misc_feature (112)..(150): Pfam Name: zf-AN1 Pfam Description: AN1-like Zinc finger
  misc_feature (1)..(171): Bit score of 234.4 for HMM based on sequences of Figure 3
  misc_feature (1)..(171): Functional Homolog Of SEQ ID NO. 451
MGSEQNEGTSFPSSQPQLCANGCGFFGTAANMNLCSKCYRDLRAEEEQAAFAKAAMEKTLNMKSQQHIDSRVAVDAPQVAVANSMQSAEASSSAETAVAAGDQVSSKPANRCFSCNKKVGLTGFMCKCGGTYCGTHRYSENHECSFDFKGAGRNAIAKANPVIKADKVGRF

SEQ ID NO: 525 - DNA, 1080 bp, Populus trichocarpa
  misc_feature (1)..(1080): Ceres Annot ID no. 1438851
  misc_feature (1)..(1080): Encodes the peptide sequence at SEQ ID NO. 526
atggtagggatcggctcggtccaattgacaaaagtacctccagctaaatacataaatgcccctctcacatttaatttctcaagccagcagttctttataaattgcacattacttttggttgataagaattccacgcataatatacgaacggtggtctctgtatctctagagattcatcggattgagtacaagaaaaagtttgaaaaacctaaccttgatttttttttggactctagaaacaagaaggaaaacatgggttctgagcaaaacgaaggtacaagctttccatcgtcacagccacagctttgtgctaatggatgtggtttttttggcacggctgcaaacatgaacctttgctccaagtgttaccgtgaccttcgtgctgaagaagagcaagctgcctttgctaaggctgctatggaaaagacgctaaacatgaagtcacaacaacatattgactctagggttgctgttgatgcccctcaagttgcggtggctaattccatgcaatccgctgaagcctcttcttcggcagaaactgctgttgctgctggcgatcaggtgtcatcgaagccggcaaataggtgcttcagctgcaataagaaggttggcttgacaggattcatgtgcaaatgcggtggcacatactgtgggactcataggtactctgagaatcacgagtgctccttcgatttcaagggtgctggccgtaatgctattgccaaggcgaatcctgtgattaaggctgataaggtggggagaagcgaagcaattagcaggaccctagattatgacagaagcacctggtattacggccaccgcttgaccctggcttgtcgaattgaaacgccatccgatttaagatttagttgtaagatgctgtacgcttacagcgagggtgttgcctgttgggggctcgaattgctttctagttttgatagtttctggagttttctcaaactgaaatcacgtcgaagagttacagcaaggaaattgaatcaatatacaacaaagctacaatggaaccgcgtcccatgtgaagaaataacttgtcaagctcggtcgaagcagggacattga

SEQ ID NO: 526 - protein, 359 aa, Populus trichocarpa
  misc_feature (1)..(359): Ceres Annot ID no. 1438851
  misc_feature (100)..(124): Pfam Name: zf-A20 Pfam Description: A20-like zinc finger
  misc_feature (196)..(234): Pfam Name: zf-AN1 Pfam Description: AN1-like Zinc finger
  misc_feature (1)..(359): Bit score of 233.0 for HMM based on sequences of Figure 3
  misc_feature (1)..(359): Functional Homolog Of SEQ ID NO. 451
MVGIGSVQLTKVPPAKYINAPLTFNFSSQQFFINCTLLLVDKNSTHNIRTVVSVSLEIHRIEYKKKFEKPNLDFFLDSRNKKENMGSEQNEGTSFPSSQPQLCANGCGFFGTAANMNLCSKCYRDLRAEEEQAAFAKAAMEKTLNMKSQQHIDSRVAVDAPQVAVANSMQSAEASSSAETAVAAGDQVSSKPANRCFSCNKKVGLTGFMCKCGGTYCGTHRYSENHECSFDFKGAGRNAIAKANPVIKADKVGRSEAISRTLDYDRSTWYYGHRLTLACRIETPSDLRFSCKMLYAYSEGVACWGLELLSSFDSFWSFLKLKSRRRVTARKLNQYTTKLQWNRVPCEEITCQARSKQGH

SEQ ID NO: 527 - DNA, 546 bp, Populus trichocarpa
  misc_feature (1)..(546): Ceres Annot ID no. 1440235
  misc_feature (1)..(546): Encodes the peptide sequence at SEQ ID NO. 528
atggctcaaagaacagagaaagaagagaccgagtgcaaggtaccagaaaacttgactttatgtatcaataattgtggagttacaggtaatccagcaacaaacaacatgtgtcagaaatgtttcaacgctagcaccagcacatctaatccctcctcctccaccaccaccaccaccaccaccataacatttgcagcaacaaccaacggtgtgtctaccaacgagatcttaaaattcaccagcgagaaatcgttgagatccagcatatctcgctcgccggcgaaggatcatcaaaggcaaccaaaaactgcgtcggataaagaaagatctgacagttcttccgtggcgaagaaagaggtgaacaggtgctcagggtgccgacgaagggtagggttgaccggattccgatgtcgttgcggggagcttttttgctgggagcaccggtactcagatcgacatgattgtagttacgattacaaaactgtaggtcgcgaagctatcgcgagagagaatcctgttgtgaaagctgcaaagattgttagagtttga

SEQ ID NO: 528 - protein, 181 aa, Populus trichocarpa
  misc_feature (1)..(181): Ceres Annot ID no. 1440235
  misc_feature (122)..(160): Pfam Name: zf-AN1 Pfam Description: AN1-like Zinc finger
  misc_feature (20)..(42): Pfam Name: zf-A20 Pfam Description: A20-like zinc finger
  misc_feature (1)..(181): Bit score of 179.1 for HMM based on sequences of Figure 3
  misc_feature (1)..(181): Functional Homolog Of SEQ ID NO. 451
MAQRTEKEETECKVPENLTLCINNCGVTGNPATNNMCQKCFNASTSTSNPSSSTTTTTTTITFAATTNGVSTNEILKFTSEKSLRSSISRSPAKDHQRQPKTASDKERSDSSSVAKKEVNRCSGCRRRVGLTGFRCRCGELFCWEHRYSDRHDCSYDYKTVGREAIARENPVVKAAKIVRV

SEQ ID NO: 529 - DNA, 540 bp, Populus trichocarpa
  misc_feature (1)..(540): Ceres Annot ID no. 1461453
  misc_feature (1)..(540): Encodes the peptide sequence at SEQ ID NO. 530
atggctcaaagagcagagaaagaagagaccgagttcaaggtaccagaaaccttgacttcatgtatcaataattgtggagttacgggtaatcctgcaactaacaacatgtgtcagaaatgtttcaacgctagcaccagcacgtctaattcttcttcctcttccaccgccactagcatgacgtttgcagcaacagccaccagcgtatctaacaacgagatcttaaaattcaccggcgagaagtcggcgagatccagcatatctcgttcgctggtgaaagatccacaaaagtcgcctgaaacagcatcggataaagaaagatcctgtgcctatcatgtggcgaagaaagaggtgaacaggtgctcagggtgccgaagaagagtgggattgactggattccggtgtcggtgtggggagctgttttgctgggagcatcggtactcagatcgacatgattgtagctacgattacaaaactgcaggtcgcgaagctatcgcgagagagaatcctgttgttaaagctgccaagattgttagagtctga

SEQ ID NO: 530 - protein, 179 aa, Populus trichocarpa
  misc_feature (1)..(179): Ceres Annot ID no. 1461453
  misc_feature (120)..(159): Pfam Name: zf-AN1 Pfam Description: AN1-like Zinc finger
  misc_feature (21)..(42): Pfam Name: zf-A20 Pfam Description: A20-like zinc finger
  misc_feature (1)..(179): Bit score of 169.7 for HMM based on sequences of Figure 3
  misc_feature (1)..(179): Functional Homolog Of SEQ ID NO. 451
MAQRAEKEETEFKVPETLTSCINNCGVTGNPATNNMCQKCFNASTSTSNSSSSSTATSMTFAATATSVSNNEILKFTGEKSARSSISRSLVKDPQKSPETASDKERSCAYHVAKKEVNRCSGCRRRVGLTGFRCRCGELFCWEHRYSDRHDCSYDYKTAGREAIARENPVVKAAKIVRV

SEQ ID NO: 531 - DNA, 462 bp, Populus trichocarpa
  misc_feature (1)..(462): Ceres Annot ID no. 1468974
  misc_feature (1)..(462): Encodes the peptide sequence at SEQ ID NO. 532
atggattcacaaagcaatttgactcctcctttgtgtgctaaggattgtgggttctttggctctccagagaagaagaatttgtgttcagagtgttacagagactatgtcgaagaagaagagtccgttgctgccgagactgccaagaaactctctcaacttgtgatcaataccccatctgctgctaatgataagagcccagctgttttaactgatgaaacaacttcaagttcagccgccgccgccgccgcatcctcttcaacagtaaagattaatagatgcgaatgctgcaacaagaaagttggattgctggggttcaagtgccgctgtgagaagaccttctgtggggttcatcgacatgccacggagcactcttgcacctttgatttcaagactcttggtcgacatattttggccgagcaaaacccacttgttgtttctgataagcttcatactagaatctga

SEQ ID NO: 532 - protein, 153 aa, Populus trichocarpa
  misc_feature (1)..(153): Ceres Annot ID no. 1468974
  misc_feature (9)..(33): Pfam Name: zf-A20 Pfam Description: A20-like zinc finger
  misc_feature (93)..(131): Pfam Name: zf-AN1 Pfam Description: AN1-like Zinc finger
  misc_feature (1)..(153): Bit score of 147.5 for HMM based on sequences of Figure 3
  misc_feature (1)..(153): Functional Homolog Of SEQ ID NO. 451
MDSQSNLTPPLCAKDCGFFGSPEKKNLCSECYRDYVEEEESVAAETAKKLSQLVINTPSAANDKSPAVLTDETTSSSAAAAAASSSTVKINRCECCNKKVGLLGFKCRCEKTFCGVHRHATEHSCTFDFKTLGRHILAEQNPLVVSDKLHTRI

SEQ ID NO: 533 - DNA, 444 bp, Populus trichocarpa
  misc_feature (1)..(444): Ceres Annot ID no. 1474244
  misc_feature (1)..(444): Encodes the peptide sequence at SEQ ID NO. 534
atggattcacaagacaagttgactcctgcgttgtgtgccaagggctgtggcttctttggctctccagagaacaaaaatctttgttcaaagtgttacaaagactatctcaaagaagaggtaattgctaagactgcagacaaactctctgaacttgtcatcaccccatcatctgatgataagaacccagctgttgtttctaatgaaacagcttcaacaaccactgctactgcatccgctacaacagtgctgaaaaatagatgtgaatgctgcggcaagaaagttggtttgatggggttcaagtgccgctgtgggaaaaccttctgtggggttcatcgatatgccaaggagcactcctgcacctttgatttcaagacttttgatcgacaaattttggctaagcaaaacccgcttgttgctggtgataaacttgatgctagaatctga

SEQ ID NO: 534 - protein, 147 aa, Populus trichocarpa
  misc_feature (1)..(147): Ceres Annot ID no. 1474244
  misc_feature (9)..(33): Pfam Name: zf-A20 Pfam Description: A20-like zinc finger
  misc_feature (87)..(125): Pfam Name: zf-AN1 Pfam Description: AN1-like Zinc finger
  misc_feature (1)..(147): Bit score of 138.0 for HMM based on sequences of Figure 3
  misc_feature (1)..(147): Functional Homolog Of SEQ ID NO. 451
MDSQDKLTPALCAKGCGFFGSPENKNLCSKCYKDYLKEEVIAKTADKLSELVITPSSDDKNPAVVSNETASTTTATASATTVLKNRCECCGKKVGLMGFKCRCGKTFCGVHRYAKEHSCTFDFKTFDRQILAKQNPLVAGDKLDARI

SEQ ID NO: 535 - protein, 170 aa, Arabidopsis thaliana
  misc_feature (1)..(170): Public GI ID no. 15231686
  misc_feature (111)..(150): Pfam Name: zf-AN1 Pfam Description: AN1-like Zinc finger
  misc_feature (14)..(36): Pfam Name: zf-A20 Pfam Description: A20-like zinc finger
  misc_feature (1)..(170): Bit score of 359.6 for HMM based on sequences of Figure 3
  misc_feature (1)..(170): Functional Homolog Of SEQ ID NO. 451
MAEEHRCQTPESNRLCVNNCGFLGSSATMNLCSNCYGDLCLKQQQQSSSIKSTVESSLSVSPPSSSSSEISSPIIPPLLKNPSVKLEVPEKKAVISLPTTEQNQQQRPNRCTTCRKRVGLTGFKCRCGTMFCGVHRYPEIHGCSYDFKSAGREEIAKANPLVKAAKLQKI

SEQ ID NO: 536 - DNA, 896 bp, Arabidopsis thaliana
  misc_feature (1)..(896): Ceres Clone ID no. 5522
  misc_feature (1)..(896): Encodes the peptide sequence at SEQ ID NO. 537
  misc_feature (27)..(27): m is a or c
  misc_feature (33)..(33): m is a or c
  misc_feature (222)..(222): s is g or c
atcgatcactgaatcttcttcttcttmttcttmttcttcttccttctctcaagaacagattttttttaaacgagcttgatcaataaattctctcaagatctatggcggaagagcatcgatgtcagacaccagaaagcaaccgtctctgtgttaacaactgtggcttcctcggcagctccgccaccatgaatctctgttctaattgttacggcgatctttgtstcaaacaacaacaacaatcctcctccatcaaatccaccgttgaatcttccctctctttatctcctccgtcgtcatcatcatcggagatctcttctccgatcatccctcctctccttaaaaatccatcagtcaagctagaggtaccggagaaaaaggcggtgatttcgctgccgacgacggagcagaatcagcaacagaggccgaatcggtgcacgacgtgtaggaaacgggtcgggttaaccggattcaagtgccggtgcggtacgatgttttgcggggttcataggtacccggagatccatggatgcagctacgatttcaaatcggccggacgtgaagagatcgcgaaagcgaatccgttggtgaaagcagcgaagcttcagaagatatgatcagagccgttcgatgcgttgacttttcctctcgtaatcttcatttctacgcgtatgtgtgtcctccgtcccccgagaaatacggatggtgtcgatttgattgatctcagccgttggatcaaaaatggtttattattgtaaaagattgattatgtattaatcaaagggacacgtgtcacgtggttttaggatggagacgctttcgctttctctccttcattttattttctttttcctttcagaaagaaataagattattcgcgttggctttttctttttatc

SEQ ID NO: 537 - protein, 170 aa, Arabidopsis thaliana
  misc_feature (1)..(170): Ceres Clone ID no. 5522
  misc_feature (111)..(150): Pfam Name: zf-AN1 Pfam Description: AN1-like Zinc finger
  misc_feature (14)..(36): Pfam Name: zf-A20 Pfam Description: A20-like zinc finger
  misc_feature (1)..(170): Bit score of 354.2 for HMM based on sequences of Figure 3
  misc_feature (1)..(170): Functional Homolog Of SEQ ID NO. 451
  misc_feature (41)..(41): Xaa is any aa, unknown or other
MAEEHRCQTPESNRLCVNNCGFLGSSATMNLCSNCYGDLCXKQQQQSSSIKSTVESSLSLSPPSSSSSEISSPIIPPLLKNPSVKLEVPEKKAVISLPTTEQNQQQRPNRCTTCRKRVGLTGFKCRCGTMFCGVHRYPEIHGCSYDFKSAGREEIAKANPLVKAAKLQKI

SEQ ID NO: 538 - DNA, 1032 bp, Arabidopsis thaliana
  misc_feature (1)..(1032): Ceres Clone ID no. 30543
  misc_feature (1)..(1032): Encodes the peptide sequence at SEQ ID NO. 539
ctttttttctcttcccaaattctctcatcgatcactgaatcgttcttcttcttcttcttcttcttcttcttcttcttcttcttccttctctcaagaacagattttttttaaacgagcttgatcaataaattctctcaagatctatggcggaagagcatcgatgtcagacaccagaaagcaaccgtctctgtgttaacaactgtggcttcctcggcagctccgccaccatgaatctctgttctaattgttacggcgatctttgtctcaaacaacaacaacaatcctcctccatcaaatccaccgttgaatcttccctctctgtatctcctccgtcgtcatcatcatcggagatctcttctccgatcatccctcctctccttaaaaatccatcagtcaagctagaggtaccggagaaaaaggcggtgatttcgctgccgacgacggagcagaatcagcaacagaggccgaatcggtgcacgacgtgtaggaaacgggtcgggttaaccggattcaagtgccggttcggtacgatgttttgcggggttcataggtacccggagatccatggatgcagctacgatttcaaatcggccggacgtgaagagatcgcgaaagcgaatccgttggtgaaagcagcgaagcttcagaagatatgatcagagccgttcgatgcgttgacttttcctctcgtaagtcttcatttctacgcgtatgtgtgtcctccgtcccccgagaaatacggatggtgtcgatttgattgatctcagccgttggatcaaaaatggtttattattgtaaaagattgattatgtatttatcaaagggacacgtgtcacgtggttttaggatggagacgctttcgctttctctccttcattttattttctttttcctttcagaaagaaataagattattcgcgttggctttttctttttattaaattccggcttattattattattattattgtgtggcttttgcgtttacaaagtctattcagaaaaataaaaaaaatgatattaatttcccac

SEQ ID NO: 539 - protein, 170 aa, Arabidopsis thaliana
  misc_feature (1)..(170): Ceres Clone ID no. 30543
  misc_feature (111)..(150): Pfam Name: zf-AN1 Pfam Description: AN1-like Zinc finger
  misc_feature (14)..(36): Pfam Name: zf-A20 Pfam Description: A20-like zinc finger
  misc_feature (1)..(170): Bit score of 349.9 for HMM based on sequences of Figure 3
  misc_feature (1)..(170): Functional Homolog Of SEQ ID NO. 451
MAEEHRCQTPESNRLCVNNCGFLGSSATMNLCSNCYGDLCLKQQQQSSSIKSTVESSLSVSPPSSSSSEISSPIIPPLLKNPSVKLEVPEKKAVISLPTTEQNQQQRPNRCTTCRKRVGLTGFKCRFGTMFCGVHRYPEIHGCSYDFKSAGREEIAKANPLVKAAKLQKI

SEQ ID NO: 540 - protein, 169 aa, Arabidopsis thaliana
  misc_feature (1)..(169): Public GI ID no. 14596167
  misc_feature (110)..(149): Pfam Name: zf-AN1 Pfam Description: AN1-like Zinc finger
  misc_feature (14)..(35): Pfam Name: zf-A20 Pfam Description: A20-like zinc finger
  misc_feature (1)..(169): Bit score of 348.0 for HMM based on sequences of Figure 3
  misc_feature (1)..(169): Functional Homolog Of SEQ ID NO. 451
MAEEHRCQTPESNRLCVNNCGFLGSATMNLCSNCYGDLCLKQQQQSSSIKSTVESSLSVSPPSSSSSEISSPIIPPLLKNPSVKLEVPEKKAVISLPTTEQNQQQRPNRCTTCRKRVGLTGFKCRCGTMFCGVHRYPEIHGCSYDFKSAGREEIAKANPLVKAAKLQKI

SEQ ID NO: 541 - DNA, 834 bp, Arabidopsis thaliana
  misc_feature (1)..(834): Ceres Clone ID no. 14203
  misc_feature (1)..(834): Encodes the peptide sequence at SEQ ID NO. 542
aataaaaatacagattctctcttcttagaaccatcaccgattcgaacagatctaataaatcgtttttttcaccagatttttttcgccggagtttgttttgatccattctgttatggcggaagaacacagacttcaagaaccacgattatgtgctaacaattgtggcttcttcggaagcacagctacacaaaatctctgttccaaatgttttcgagatcttcaacatcaagaacaaaactcttccaccgccaaacatgctcttacccaatccttagccgccgttggcgctgctgcgtcttcctccgtgtcgccaccgcctccgcctccagctgattcgaaagaaatcgttgaagcgaaatcagagaaacgagcggcggctgaaccggaggaggcggatggtccgccgcaagatccgaagcggtgtttgacttgtcggcggcgcgtgggaatcacggggtttcggtgtaggtgtggtttcgttttctgcgggacgcataggtacgcggagcaacatgaatgttcgtttgatttcaagcggatggggaaggataagatcgctaaagcgaatccgattgtgaaagctgataagcttgagaagatttgactttgttgtttgttgtttgttgttgttgctttggttttgtgcgtttgaatgaaacacacatgaagaagaaagagcaagaaacaaacatgtcaatgtaaatttaagctttatttgatgatttcttcagtttggttattaaatttgcttattattgatttgattgttccgtttgatgatcttgtagaaggcttaagtcgtattatcaatgtgtagaatttggatttggttgg

SEQ ID NO: 542 - protein, 163 aa, Arabidopsis thaliana
  misc_feature (1)..(163): Ceres Clone ID no. 14203
  misc_feature (10)..(34): Pfam Name: zf-A20 Pfam Description: A20-like zinc finger
  misc_feature (104)..(142): Pfam Name: zf-AN1 Pfam Description: AN1-like Zinc finger
  misc_feature (1)..(163): Bit score of 290.5 for HMM based on sequences of Figure 3
  misc_feature (1)..(163): Functional Homolog Of SEQ ID NO. 451
MAEEHRLQEPRLCANNCGFFGSTATQNLCSKCFRDLQHQEQNSSTAKHALTQSLAAVGAAASSSVSPPPPPPADSKEIVEAKSEKRAAAEPEEADGPPQDPKRCLTCRRRVGITGFRCRCGFVFCGTHRYAEQHECSFDFKRMGKDKIAKANPIVKADKLEKI

SEQ ID NO: 543 - DNA, 859 bp, Arabidopsis thaliana
  misc_feature (1)..(859): Ceres Clone ID no. 13832
  misc_feature (1)..(859): Encodes the peptide sequence at SEQ ID NO. 544
acgtgtttctgtttttctctaatttttctcttgttgttctcgattaacgaaaaagacttgtcgttctcaattcttatcgatttaagaacaaatcatctaacgaagattacttccgaagatcagaaacaaacacaaactgtgaatcgttgtttgttaattctctttaaaatcgccagaagaaagagatctccgttttctacagaagaaaagcaagagagtaagaatgggatcggaacaaaacgatagcacaagcttcacgcaatcgcaagcttcagagccaaagctatgtgttaaaggatgtggtttctttggatcaccatcaaacatggatctctgttctaaatgttacagaggcatttgtgctgaggaagctcaaacagcagttgctaaagctgctgttgaaaaatctttcaagccttctcctcctcgtagtctcttcatagcagaacctcctgctgttgttgtggaacccaaacccgaaaaggcggcagttgttgttgtctcggccgagccatcttcctcggcggttcctgaggcgaacgagccatcgagacctgcacgaaccaaccggtgtttgtgttgtaacaagaaggttgggatcatggggtttaagtgcaaatgcgggagcactatctgcggcgatcatcggtacccggagactcatgattgcagctttgatttcaaagaagttggacgtggagagattgccaaagctaatcctgtggttaaggctgataaaattcaaaggttctgaaatatggaagttttttctaagtattttggtggtaattactcatttgtatttgaaccgatttgggggttgtcttggatggttttaatggattgtttccaaagggac

SEQ ID NO: 544 - protein, 176 aa, Arabidopsis thaliana
  misc_feature (1)..(176): Ceres Clone ID no. 13832
  misc_feature (19)..(43): Pfam Name: zf-A20 Pfam Description: A20-like zinc finger
  misc_feature (117)..(155): Pfam Name: zf-AN1 Pfam Description: AN1-like Zinc finger
  misc_feature (1)..(176): Bit score of 202.3 for HMM based on sequences of Figure 3
  misc_feature (1)..(176): Functional Homolog Of SEQ ID NO. 451
MGSEQNDSTSFTQSQASEPKLCVKGCGFFGSPSNMDLCSKCYRGICAEEAQTAVAKAAVEKSFKPSPPRSLFIAEPPAVVVEPKPEKAAVVVVSAEPSSSAVPEANEPSRPARTNRCLCCNKKVGIMGFKCKCGSTICGDHRYPETHDCSFDFKEVGRGEIAKANPVVKADKIQRF

SEQ ID NO: 545 - protein, 168 aa, Arabidopsis thaliana
  misc_feature (1)..(168): Public GI ID no. 15221329
  misc_feature (109)..(146): Pfam Name: zf-AN1 Pfam Description: AN1-like Zinc finger
  misc_feature (16)..(40): Pfam Name: zf-A20 Pfam Description: A20-like zinc finger
  misc_feature (1)..(168): Bit score of 236.7 for HMM based on sequences of Figure 3
  misc_feature (1)..(168): Functional Homolog Of SEQ ID NO. 451
MGSEQNDSTSFSPSEPKLCVKGCGFFGSPSNMNLCSKCYRDIRATEEQTASAKAAVEKSLNPNKPKTQPQQSQEITQGVLGSGSSSSSTRGGDSAAAPLDPPKSTATRCLSCNKKVGVTGFKCRCGSTFCGTHRYPESHECQFDFKGVAREAIAKANPVVKADKVDRI

SEQ ID NO: 546 - DNA, 666 bp, Brassica napus
  misc_feature (1)..(666): Ceres Clone ID no. 975913
  misc_feature (1)..(666): Encodes the peptide sequence at SEQ ID NO. 547
atttcatttctgtttggttgctgagaaaacggaggaaaattttctgaatttttctttctcggtgaccagattccggttcgtgttttgttcttcttttctaaactctgtagatttattaccgtctttttatttgttttcagatatttttgacgagctttattgatttaagttcttgaattacaatcaagatccatggcggaagagcatcgatgtcaaacgccggaaggccaccgtctctgtgctaacaactgcggcttcctcggcagctccgcgaccatgaatctatgctccaactgctacggcgatctctgtcttaaacaacagcaacaaggctcatcctctctctccgccgtatctcctccgccgccggtgatcacttccatctctactccgatgatccagcctctcgttcaaaacccatctgctgaattggaggtaccggcgaagaacgtgtcggtgacggtaacggcgacggagcagccgcagaaacggccgaaccggtgtaccacgtgcaggaaacgggtcgggttgaccgggttcaagtgccggtgtgggacgactttttgtggggcccacaggtatccggaggtccatggatgcaccttcgatttcaaatcggccggtcgcgaagagatcgcgaaggcgaacccgttggtcaaagcggcg

SEQ ID NO: 547 - protein, 158 aa, Brassica napus
  misc_feature (1)..(158): Ceres Clone ID no. 975913
  misc_feature (104)..(143): Pfam Name: zf-AN1 Pfam Description: AN1-like Zinc finger
  misc_feature (14)..(36): Pfam Name: zf-A20 Pfam Description: A20-like zinc finger
  misc_feature (1)..(158): Bit score of 331.9 for HMM based on sequences of Figure 3
  misc_feature (1)..(158): Functional Homolog Of SEQ ID NO. 451
MAEEHRCQTPEGHRLCANNCGFLGSSATMNLCSNCYGDLCLKQQQQGSSSLSAVSPPPPVITSISTPMIQPLVQNPSAELEVPAKNVSVTVTATEQPQKRPNRCTTCRKRVGLTGFKCRCGTTFCGAHRYPEVHGCTFDFKSAGREEIAKANPLVKAA

SEQ ID NO: 548 - DNA, 961 bp, Brassica napus
  misc_feature (1)..(961): Ceres Clone ID no. 967417
  misc_feature (1)..(961): Encodes the peptide sequence at SEQ ID NO. 549
  misc_feature (663)..(663): m is a or c
gtacaaatattcgatttttcagcagcgtcgtctctgtttccatcttctttctctttcttctcccttcccgatttcatcgttaattggtaaagaaaaaaagtcagtgaatcatctctcttcttcttcttcttctctcaagaacaggttttcggtttaaagcctcgaaattctctatggcggaagagcatcgatgtcagacgccggaaggccaccgtctctgtgctaacaactgcggcttcctcggcagctccgccaccatgaatctatgctccaactgctacggcgatctctgccttaagcaacagcaagcttccatgaaatccaccgtcgaatcctctctctccgccgtatctcctccgtcgtcagagatcggttctatgcaatccaccgttgaatcctctctctccgacgtatctcctccatcatcggagaccatttccatctcttctccaatgatccagcctctcgttcgaaacccatcagctgaactggaggtaacggcgaagaacgttccgaagacggtgactccgccgccggagcagcagcagaaacggccgaatcggtgcacgacgtgtaggaaacgggtcgggttgactgggttcaagtgccggtgcggaacgactttttgcggggctcacaggtacccggaggtccatggatgcmccttcgatttcaaatcggccggtcgcgaagagatcgccaaggcgaacccactcgtcaaagcggcgaagcttcagaagatttgatcgccgccgttcgatgcgttgacttttaaaccatcatttgaacgcgtttgtctcccccagaaatggtgttagattgatctcagccgttcatgatgtgtcattatgtaaaagatatgtactacgaaggacacgtgtcacgtgacgttttcctcatcttcccaattaattttcttttccccttaaagaaataagattattcgcgttggcttttctct

SEQ ID NO: 549 - protein, 190 aa, Brassica napus
  misc_feature (1)..(190): Ceres Clone ID no. 967417
  misc_feature (131)..(170): Pfam Name: zf-AN1 Pfam Description: AN1-like Zinc finger
  misc_feature (14)..(36): Pfam Name: zf-A20 Pfam Description: A20-like zinc finger
  misc_feature (1)..(190): Bit score of 357.8 for HMM based on sequences of Figure 3
  misc_feature (1)..(190): Functional Homolog Of SEQ ID NO. 451
  misc_feature (164)..(164): Xaa is any aa, unknown or other
MAEEHRCQTPEGHRLCANNCGFLGSSATMNLCSNCYGDLCLKQQQASMKSTVESSLSAVSPPSSEIGSMQSTVESSLSDVSPPSSETISISSPMIQPLVRNPSAELEVTAKNVPKTVTPPPEQQQKRPNRCTTCRKRVGLTGFKCRCGTTFCGAHRYPEVHGCXFDFKSAGREEIAKANPLVKAAKLQKI

SEQ ID NO: 550 - DNA, 932 bp, Brassica napus
  misc_feature (1)..(932): Ceres Clone ID no. 974951
  misc_feature (1)..(932): Encodes the peptide sequence at SEQ ID NO. 551
  misc_feature (401)..(401): s is g or c
  misc_feature (722)..(722): y is t/u or c
  misc_feature (812)..(812): y is t/u or c
ttccttttctcataccccttctttcatcatcttcttccctttctctctcaacattcccattccttccctattccatcgatcttctctacgcttttatatacataactcattatccatccacccttattccctcatctctcaacgttctattttcttctcgaatatcacagaacccgattagatctatagatcttgtttctccagattaggacatcatgtcggaagaacacaggcttcaggagccacggttatgcgctaacgattgcggtttcttcggaaacaccgccacgcagaatctctgctctaaatgttttagagatctaaagcacgaacaggagaactcctccaccgccaaaaacgcccttaagcagactctcgccgcctgtgttgcgtcctcctcsgtatcctcaccgcctcctcctcctcctccagccgatctgacttcagatctgaaagaagtcaacacagagaatccggggaaacgggcagcgagcgagcccgaggaggaggaggagcagaagccgccgcaagatcctaaacgctgtttgacttgccggcggcgcgtggggatcacaggcttcaggtgcaggtgtgggttcgtgttttgtggaacccataggtacgccgagcagcacgagtgcactttcgatttcaagcgggtcgggaaggagaagatcgctaaggcgaatccgattgtgaaagcggagaagctcgagaagatytgaaagaattgtgtttggtgtaaatttatcatcatcaattttaagctttaatttgatttcttctcggtttggttataaaatgatgtgttytcttattagttttcgataattgtttttacaaccattgtttgattgttcagtttagttatcagctatgatattagggaacaatcaaagccattctctcaacgtagctgtgaattttttgct

SEQ ID NO: 551 - protein, 169 aa, Brassica napus
  misc_feature (1)..(169): Ceres Clone ID no. 974951
  misc_feature (10)..(34): Pfam Name: zf-A20 Pfam Description: A20-like zinc finger
  misc_feature (110)..(148): Pfam Name: zf-AN1 Pfam Description: AN1-like Zinc finger
  misc_feature (1)..(169): Bit score of 263.9 for HMM based on sequences of Figure 3
  misc_feature (1)..(169): Functional Homolog Of SEQ ID NO. 451
  misc_feature (62)..(62): Xaa is any aa, unknown or other
  misc_feature (169)..(169): Xaa is any aa, unknown or other
MSEEHRLQEPRLCANDCGFFGNTATQNLCSKCFRDLKHEQENSSTAKNALKQTLAACVASSXVSSPPPPPPPADLTSDLKEVNTENPGKRAASEPEEEEEQKPPQDPKRCLTCRRRVGITGFRCRCGFVFCGTHRYAEQHECTFDFKRVGKEKIAKANPIVKAEKLEKX

SEQ ID NO: 552 - DNA, 951 bp, Brassica napus
  misc_feature (1)..(951): Ceres Clone ID no. 958471
  misc_feature (1)..(951): Encodes the peptide sequence at SEQ ID NO. 553
  misc_feature (595)..(595): s is g or c
  misc_feature (598)..(598): s is g or c
  misc_feature (639)..(639): r is g or a
  misc_feature (682)..(682): y is t/u or c
  misc_feature (696)..(696): y is t/u or c
  misc_feature (761)..(761): m is a or c
  misc_feature (766)..(766): y is t/u or c
  misc_feature (791)..(791): r is g or a
  misc_feature (793)..(793): r is g or a
gaaactcagaaaagcagagaactttattctctcctctaacctctcaacttctgctggatctctccagcagacggaagatcttcttcggagagattcttaggggaccgaacgatctatcgatcaaggcttctcgggcaaacagaagtgcagaaatggaccacgacaagacaggatgccaaagcccacccgagggtcccaagctatgcatcaacaactgcggtttcttcggaagcgctgccacaatgaacatgtgttccaagtgccacaagactatcttgtttcaacaggaacagggggccaagcttgcatctgcagtgtctggatcacccagcaacatcctaaaggaaaccttcactgctgatttggttgatgctggaaccaaatccatcgagcctgtggctgtctctgtacaagctgttgcagaggtagtagcaccagaagaagctgcagcaaaaccaaaggaagggcccagccgatgtactacttgcaacaaacgggttggtttgactggattcaaatgtcgatgtggtgacctcttctgtggtacgcaccgctatgcagacgttcataactgctctttcgattaccatgttgstgsgcaagaagctatagccaaagcgaacccggttgtgaaggcarataagcttgacaagatttgaaactcagaaactatgtttccttyttcatgtccgtgtytggttcaagcgtgtgttgatctttagcttcttccgttctctctgccagtatctgtggtgtgaaamctttytatattatcttgtgtttgcaagcararaagtgtgctcttaaatatatatatatgctttgatgtgtttctctttttttttttttaatattatttatgagcactatggtttggttatgtttactcctttgggtctgtatcatattgagattgtaactttagctatatgaagatttttcttaaaagct

SEQ ID NO: 553 - protein, 168 aa, Brassica napus
  misc_feature (1)..(168): Ceres Clone ID no. 958471
  misc_feature (15)..(39): Pfam Name: zf-A20 Pfam Description: A20-like zinc finger
  misc_feature (109)..(146): Pfam Name: zf-AN1 Pfam Description: AN1-like Zinc finger
  misc_feature (1)..(168): Bit score of 265.0 for HMM based on sequences of Figure 3
  misc_feature (1)..(168): Functional Homolog Of SEQ ID NO. 451
  misc_feature (148)..(148): Xaa is any aa, unknown or other
  misc_feature (149)..(149): Xaa is any aa, unknown or other
  misc_feature (163)..(163): Xaa is any aa, unknown or other
MDHDKTGCQSPPEGPKLCINNCGFFGSAATMNMCSKCHKTILFQQEQGAKLASAVSGSPSNILKETFTADLVDAGTKSIEPVAVSVQAVAEVVAPEEAAAKPKEGPSRCTTCNKRVGLTGFKCRCGDLFCGTHRYADVHNCSFDYHVXXQEAIAKANPVVKAXKLDKI

SEQ ID NO: 554 - DNA, 852 bp, Brassica napus
  misc_feature (1)..(852): Ceres Clone ID no. 979956
  misc_feature (1)..(852): Encodes the peptide sequence at SEQ ID NO. 555
  misc_feature (379)..(379): y is t/u or c
  misc_feature (617)..(617): r is g or a
  misc_feature (632)..(632): y is t/u or c
  misc_feature (805)..(805): y is t/u or c
  misc_feature (814)..(814): r is g or a
  misc_feature (831)..(831): y is t/u or c
  misc_feature (846)..(846): y is t/u or c
  misc_feature (850)..(850): s is g or c
atcgaagagagaaaagccgaaacctttttttctctcgtctccaattttctcagcttctgctggatctctccagcatccttcctcggagagattcgtatgaaatggaccacgacaaaacaggatgccaaagcccacctgaaggtcccaagctatgcatcaacaactgcggtttcttcggaagcgctgccacaatgaacatgtgttccaagtgtcacaaggctatcctgtttcaacaggaacagggggctaagtttgcatctgcagtgtctggtggtacatcatcatccagcaacatcttaaaggaaacctttgctgctaccgcgctggttgatgctgaaaccaaatccgttgagccggtggctgtctctgtacagccatyttctgtccaagttgccgcagaggtagtagctccagaagccgctgcagcaaaactaaaggaaggaccaagccgatgtgctacttgcaataaacgggttggtctgactggattcaaatgtcgctgtggtgacctcttctgcgggacgcaccgttatgcagacatacacaactgctccttcaattaccatgccgctgcgcaagaagctatagctaaagcaaacccggttgtgaaggcagaraagcttgacaaaatytgaaactcaaacaccaaagtgatagactacgacatccttgggaacatttagaattggaaaagaaggtttagaattttacatatttattattattgcctataagagggagacatttgattctaataaaatcatccattaagagatcaaagaaacggggttgtctcctctaaatytaataaacraggagtttgtcagtttyttgaataaatagcayattsat

SEQ ID NO: 555 - protein, 177 aa, Brassica napus
  misc_feature (1)..(177): Ceres Clone ID no. 979956
  misc_feature (118)..(156): Pfam Name: zf-AN1 Pfam Description: AN1-like Zinc finger
  misc_feature (15)..(39): Pfam Name: zf-A20 Pfam Description: A20-like zinc finger
  misc_feature (1)..(177): Bit score of 252.6 for HMM based on sequences of Figure 3
  misc_feature (1)..(177): Functional Homolog Of SEQ ID NO. 451
  misc_feature (93)..(93): Xaa is any aa, unknown or other
  misc_feature (172)..(172): Xaa is any aa, unknown or other
  misc_feature (177)..(177): Xaa is any aa, unknown or other
MDHDKTGCQSPPEGPKLCINNCGFFGSAATMNMCSKCHKAILFQQEQGAKFASAVSGGTSSSSNILKETFAATALVDAETKSVEPVAVSVQPXSVQVAAEVVAPEAAAAKLKEGPSRCATCNKRVGLTGFKCRCGDLFCGTHRYADIHNCSFNYHAAAQEAIAKANPVVKAXKLDKX

SEQ ID NO: 556 - DNA, 881 bp, Brassica napus
  misc_feature (1)..(881): Ceres Clone ID no. 962327
  misc_feature (1)..(881): Encodes the peptide sequence at SEQ ID NO. 557
  misc_feature (653)..(653): m is a or c
  misc_feature (676)..(676): r is g or a
  misc_feature (753)..(753): m is a or c
  misc_feature (843)..(843): y is t/u or c
  misc_feature (870)..(870): y is t/u or c
gttgcgtgtttgtttgtctctctcatctcgctcacctaaattcgcaaaaaatattctgaacaatattgaacagaaaaccaagaaacccactttttatttcttctccgaaagatcagaaatatattttattttgtcaaatttcgttgaagaagctttgaaattaggggaacaaatttcatttgatctgcacgtttctgatttgagaagaaggagaaaggaacaacaatgagctctgagcaaaacaacagcacaagcttcccaccaactgagccaaaactctgcgacaacggatgcggtttcttcgggtcaccttccaacatgaacctctgttccaaatgctacagaagtctccgagccgaggaagatcaaaccgccgtagcaaaagctgctgtcaagaactcacttaagcttccatcttgcagtctcattatcacaccagagcaaaaacagcctcttgaaaccaaaccagcctctgttgttgtaaccgctgagccgtcttcagttcctatagccacgggacaggaggaggcagagccgtcgaaacctgcgcggacgaacaggtgtttcagctgtaacaagaaggttggagttatggggtttaagtgcaaatgcggtagcacgttttgcgggagccataggtacccggagaagcmcgagtgtagcttcgatttcaaaraagttggacgtgatgcaatcgcaaaggccaatcctgtgatcaaggcggataaagtcgaaaggatatgaaaaatatcmaaccttttctttttataaagtaatttgtggtttctattttcaacttctttggatgtcgatgtgatgtgatcatgttggatgttgggtttytatgaatcataatgaaaattgctgctyttggttttatc

SEQ ID NO: 557 - protein, 172 aa, Brassica napus
  misc_feature (1)..(172): Ceres Clone ID no. 962327
  misc_feature (17)..(40): Pfam Name: zf-A20 Pfam Description: A20-like zinc finger
  misc_feature (113)..(150): Pfam Name: zf-AN1 Pfam Description: AN1-like Zinc finger
  misc_feature (1)..(172): Bit score of 204.8 for HMM based on sequences of Figure 3
  misc_feature (1)..(172): Functional Homolog Of SEQ ID NO. 451
  misc_feature (143)..(143): Xaa is any aa, unknown or other
  misc_feature (151)..(151): Xaa is any aa, unknown or other
MSSEQNNSTSFPPTEPKLCDNGCGFFGSPSNMNLCSKCYRSLRAEEDQTAVAKAAVKNSLKLPSCSLIITPEQKQPLETKPASVVVTAEPSSVPIATGQEEAEPSKPARTNRCFSCNKKVGVMGFKCKCGSTFCGSHRYPEKXECSFDFKXVGRDAIAKANPVIKADKVERI

SEQ ID NO: 558 - protein, 175 aa, Brassica rapa
  misc_feature (1)..(175): Public GI ID no. 119720772
  misc_feature (116)..(154): Pfam Name: zf-AN1 Pfam Description: AN1-like Zinc finger
  misc_feature (17)..(40): Pfam Name: zf-A20 Pfam Description: A20-like zinc finger
  misc_feature (1)..(175): Bit score of 227.2 for HMM based on sequences of Figure 3
  misc_feature (1)..(175): Functional Homolog Of SEQ ID NO. 451
MSSEQNNSTSFPPTEPKLCDNGCGFFGSPSNMNLCSKCYRSLRAEEDQTAVAKAAVEKSLKLPSCSLITAPAPKQPLETKPASVETVVIAETSSVPPVATGQDEGEPSKPARPNRCFSCNKKVGVMGFKCKCGSTFCGSHRYPEKHECSFDFKEVGRGAIAKANPVVKADKVQRI

SEQ ID NO: 559 - DNA, 920 bp, Glycine max
  misc_feature (1)..(920): Ceres Clone ID no. 1614593
  misc_feature (1)..(920): Encodes the peptide sequence at SEQ ID NO. 560
attctccgttaagattctttcttctttcctctttccactcttggtcttatcttcttcacaatcccacaaccactccttgttataaatcagatccaaacatggccgaagaacaccgatgccaagctcccgaaggtcacagactctgctccaacaactgcggcttcttcggtagccccgccacaatgaatctctgttccaaatgctacagagacatccgtttgaaggaagaagaacaagccaaaactaaatccacaatcgaaaccgctctttctggatcttcctccgccaccgtcgccgttgcctccgccgtggattctcttccggcgccggttgaatccctccctcaaccgtcggtggtgagttcgccagatgtggccgcaccggttcaggcgaaccggtgcggcgcgtgtaggaagcgcgtgggattgactgggtttaagtgcaggtgcggaaccacgttttgtgggactcaccggtaccccgagaaacacgcgtgtggcttcgatttcaaggcggtggggagagaggagatagcacgggcgaatcccgtgatcaaaggcgagaagctacggaggatttaatctgcaccgttgatatgatgatcgaagcgattagggtgagttgatcaggaccgtccgtcgtgggccgttgatacgaacctatttcgagcgtgtgtaagaaaaaaaaaatctattagttatgacgacattgggaagggttgaataagtcatattttggaggctttgctttgtgtttgttcattaaaaatggaaaatgttaggtccacccacgttcggaaattgaggggtttgtttagaattgcaatgcaatgtaaaaaagtgtagtttaatatttttctacaggcatttctatttttcttccgtttgcgagaaaggtaaattatcgtctgcgttgtattc

SEQ ID NO: 560 - protein, 160 aa, Glycine max
  misc_feature (1)..(160): Ceres Clone ID no. 1614593
  misc_feature (101)..(139): Pfam Name: zf-AN1 Pfam Description: AN1-like Zinc finger
  misc_feature (14)..(37): Pfam Name: zf-A20 Pfam Description: A20-like zinc finger
  misc_feature (1)..(160): Bit score of 389.6 for HMM based on sequences of Figure 3
  misc_feature (1)..(160): Functional Homolog Of SEQ ID NO. 451
MAEEHRCQAPEGHRLCSNNCGFFGSPATMNLCSKCYRDIRLKEEEQAKTKSTIETALSGSSSATVAVASAVDSLPAPVESLPQPSVVSSPDVAAPVQANRCGACRKRVGLTGFKCRCGTTFCGTHRYPEKHACGFDFKAVGREEIARANPVIKGEKLRRI

SEQ ID NO: 561 - DNA, 1292 bp, Glycine max
  misc_feature (1)..(1292): Ceres Clone ID no. 567184
  misc_feature (1)..(1292): Encodes the peptide sequence at SEQ ID NO. 562
aacctgtatttttcgttttctcaatttccgcttattttcgttccagccagagccagcttttccattttcccctttaaattttctccgaatccaaacggaaccgtaatcgtttcttattccttttttgtttgtttgtttctttctctctccccgccaggttcagagacttttccgattcctggaagaagagaagagaaaacctaaatcacagatccatggcggaagaacaccgatgtgaacctcccgaaggtcaccgactctgcgtcaacaactgcggcttcttcggtagcaccgccacgatgaacctctgctccaaatgctacagcgcgatccgtttgaaggagcaagaagaagcgtcgacgaaatccacaatcgaaaccgcgctctcttctgcctcctcggcgaaaccgtcgtcgtccacgtcacctccgccgtcggcggtcgatgtgctcatggaatctccaccgccgtctgcggcggaggttgaggttgctgtcacggtcacggtcgcggtggcgtcgagttctatttccataaactcaggttcggttgcgcaaccgaaccggtgtgccacgtgtcggaagcgcgtggggctgaccgggttcaagtgcaggtgcggagtgacgttctgcggggcccacaggtacccggaggagcacgcgtgcgggttcgatttcaagacagtgggaagagaggagattgcacgtgccaaccccgtgatcaaagcggagaagctgcggaggatttgatgatttcaatctgggccgttcgatgggaccggagcttggtgatttaatctccaccgtcctcgtgtatgcgagagaaagaaaaagagagagtgagagggaaaatgcggttattatgtaacattatgattatgatgatctgtgttttaattaagacgaaagcttgaaaagtcggtttgtctggtctagaagggatgatgaaatgaacgagtcatatttatttggctttggtccactgtcgggggtggttgaaagttgaaatgatttgtgataagagtctcagggcaacgatgcagtacggtggagcgttttattgtaatgaatgtgaaagtgaaattattctactccaagatattttttgtttttttttatcctgcttgaatgatttatatgcctagtatgctctatgacagaggagaagggagtgcgttatgtttccaccaccgacggtgatgaatcaattgttttcaattgcgagagtggggtttccaaacccgtatttcctcaatgttgattatattaattttaattaggtttttctgattc

SEQ ID NO: 562 - protein, 177 aa, Glycine max
  misc_feature (1)..(177): Ceres Clone ID no. 567184
  misc_feature (118)..(156): Pfam Name: zf-AN1 Pfam Description: AN1-like Zinc finger
  misc_feature (14)..(36): Pfam Name: zf-A20 Pfam Description: A20-like zinc finger
  misc_feature (1)..(177): Bit score of 362.8 for HMM based on sequences of Figure 3
  misc_feature (1)..(177): Functional Homolog Of SEQ ID NO. 451
MAEEHRCEPPEGHRLCVNNCGFFGSTATMNLCSKCYSAIRLKEQEEASTKSTIETALSSASSAKPSSSTSPPPSAVDVLMESPPPSAAEVEVAVTVTVAVASSSISINSGSVAQPNRCATCRKRVGLTGFKCRCGVTFCGAHRYPEEHACGFDFKTVGREEIARANPVIKAEKLRRI

SEQ ID NO: 563 - DNA, 582 bp, Glycine max
  misc_feature (1)..(582): Ceres Clone ID no. 580467
  misc_feature (1)..(582): Encodes the peptide sequence at SEQ ID NO. 564
  misc_feature (579)..(579): k is g or t/u
aaaatgccgcagcagcgcgctgtttggtaccaacacaaaatctaacccgcattttctctgtcatccaaacaacccctttcgcctcagatctctcgccgcgagaacatggatcaattgtcggcgatcagcgaggacctggccgagatcgacggacacatcgccgacaatttccgcgccctatcaaatggatttcagaagttggagaagattaaggattcgaatagacagagcaggcagttggaagacctcacggaaaaattgcgagaatgtaaacggtaattttcacctgtcacattgatgcaaactatgtgcaagagagccgaagattgttcattttgttggctgcaaggttttaaacatcggtcgcggtcacgttgccattttgtcgtgtttgttgatatcccgacaaatgcagccgatgcggtcccaattgcagtcacggacagttgaaaaaccttgatgttgcatcccaaacggttgcgggctgtttgttaaaaccttaacgcttgttatcattttcagatctgttttgaaaatttgtaatcagaaacttgtgtatagagtgccattttgatctgkgtt

SEQ ID NO: 564 - protein, 158 aa, Glycine max
  misc_feature (1)..(158): Ceres Clone ID no. 580467
  misc_feature (13)..(34): Pfam Name: zf-A20 Pfam Description: A20-like zinc finger
  misc_feature (99)..(137): Pfam Name: zf-AN1 Pfam Description: AN1-like Zinc finger
  misc_feature (1)..(158): Bit score of 333.6 for HMM based on sequences of Figure 3
  misc_feature (1)..(158): Functional Homolog Of SEQ ID NO. 451
MAEEHRCQAPRFCANNCGFFGSPATQNMCSKCYRDFQLKEQQSSNAKMVLNQSLVPSPPPAVISQPSSSSSAAVDPSSAVVDDAPRESEEVKAPQQNRCMTCRRRVGLTGFKCRCGMMLCGTHRYPEQHACEFDFKGMGREQIAKANPVVKGEKLDKI

SEQ ID NO: 565 - DNA, 700 bp, Glycine max
  misc_feature (1)..(700): Ceres Clone ID no. 1626661
  misc_feature (1)..(700): Encodes the peptide sequence at SEQ ID NO. 566
  misc_feature (590)..(590): n is a, c, t, g, unknown, or other
accatcgttcttattatcccctcttccctcttctcattccaaacctcaacaaggttcagatacttttccgattccgtcgcgaatttccgattcatcgaagaagaagagaaaacctaaatcgcagatccgaacgcagtaaaaaaaccatggcggaagaacaccgatgcgaaactcccgaaggtcacctactctgcgccaacaactgcggcttctccggtagcaccgccacgatgaacctctgctcgaaatgctacggcgcgatccgcttgaaggagcaagaagaagcgtcgacgaaatctacaatcgaaaccgcgctctcttcttcctcgttgaaaccgtcgttctccacgtcacctccaacgttggtggatgtcctcatcgaatcgccgccgccgtctttggcggaggttgcggtcacggtggcggtggaggcgtcgagttctatttccacaagctcaggttcggttgcgcaaccgaaccggtgtgccacgtgtcggaagcgcgtggggctgaccgggttcaagtgcaggtgcggattgacgttctgcggggcccacaggtactcggagaagcacgcgtgcgggttcgantttaagacggtggggaagagaggagattgcacgtgccaaccccgtgatcaaagcggagaagctgcggaggatttgatgattcgttctcggccgttcgatgggacccggat

SEQ ID NO: 566 - protein, 184 aa, Glycine max
  misc_feature (1)..(184): Ceres Clone ID no. 1626661
  misc_feature (113)..(151): Pfam Name: zf-AN1 Pfam Description: AN1-like Zinc finger
  misc_feature (14)..(36): Pfam Name: zf-A20 Pfam Description: A20-like zinc finger
  misc_feature (1)..(184): Bit score of 251.0 for HMM based on sequences of Figure 3
  misc_feature (1)..(184): Functional Homolog Of SEQ ID NO. 451
  misc_feature (148)..(148): Xaa is any aa, unknown or other
MAEEHRCETPEGHLLCANNCGFSGSTATMNLCSKCYGAIRLKEQEEASTKSTIETALSSSSLKPSFSTSPPTLVDVLIESPPPSLAEVAVTVAVEASSSISTSSGSVAQPNRCATCRKRVGLTGFKCRCGLTFCGAHRYSEKHACGFXFKTVGKRGDCTCQPRDQSGEAAEDLMIRSRPFDGTR

SEQ ID NO: 567 - DNA, 776 bp, Brassica napus
  misc_feature (1)..(776): Ceres Clone ID no. 1021029
  misc_feature (1)..(776): Encodes the peptide sequence at SEQ ID NO. 568
attccatcgatcttctctacgcttttatatacataactcattatccatccacccttattccctcatctctcaacgttctattttcttctcgaatatcacagaacccgattagatctatagatcttgtttctccagattaggacatcatgtcggaagaacacaggcttcaggagccacggttatgcgctaacgattgcggtttcttcggaaacaccgccacgcagaatctctgctctaaatgttttagagatctaaagcacgaacaggagaactcctccaccgccaaaaacgcccttaagcagactctcgccgcctgtgttgcgtcctcctccgtatcctcaccgcctcctcctcctcctccagccgatctgacttcagatctgaaagaagtcaacacagagaatccggggaaacgggcagcgagcgagcccgaggaggaggaggagcagaagccgccgcaagatcctaaacgctgtttgacttgccggcggcgcgtggggatcacaggcttcaggtgcaggtgtgggttcgtgttttgtggaacccataggtacgccgagcagcacgagtgcactttcgatttcaagcgggtcgggaaggagaagatcgctaaggcgaatccgattgtgaaagcggagaagctcgagaagatctgaaagaattgtgtttggtgtaaatttatcatcatcaattttaagctttaatttgatttcttctcggtttggttataaaatgatgtgttctcttattagttttcgataattgtttttacaacc

SEQ ID NO: 568 - protein, 169 aa, Brassica napus
  misc_feature (1)..(169): Ceres Clone ID no. 1021029
  misc_feature (10)..(34): Pfam Name: zf-A20 Pfam Description: A20-like zinc finger
  misc_feature (110)..(148): Pfam Name: zf-AN1 Pfam Description: AN1-like Zinc finger
  misc_feature (1)..(169): Bit score of 274.7 for HMM based on sequences of Figure 3
  misc_feature (1)..(169): Functional Homolog Of SEQ ID NO. 451
MSEEHRLQEPRLCANDCGFFGNTATQNLCSKCFRDLKHEQENSSTAKNALKQTLAACVASSSVSSPPPPPPPADLTSDLKEVNTENPGKRAASEPEEEEEQKPPQDPKRCLTCRRRVGITGFRCRCGFVFCGTHRYAEQHECTFDFKRVGKEKIAKANPIVKAEKLEKI

SEQ ID NO: 569 - DNA, 892 bp, Brassica napus
  misc_feature (1)..(892): Ceres Clone ID no. 1072112
  misc_feature (1)..(892): Encodes the peptide sequence at SEQ ID NO. 570
aacctttttttctctcgtctccaattttctcagcttctgctggatctctccagcagagacgatccttcctacgggactgtttgatcaatcaaggcttctcgggcaaacaggtgaatagaagtgagattaggctatgtgggttttgtatgttttacagatttgctattgaaggttcatttctaagaaggaagaaatggaccacgacaagacaggatgccaaagcccacctgaaggtcccaagctatgcatcaacaactgcggtttcttcggaagctctgccacaatgaacatgtgttccaagtgtcacaaggctatcctgtttcaacaggaacagggggctaggtttgcatctgcagtgtctggtggtacatcttcatccagcaacatcttaaaggaaacctttgctgctaccgcgctggttgatgctgaaaccaaatccgttgagccggtggctgtctctttacagccatcttctgtccaagtcgtcgtcgcagaggtagtagctccagaagcagctgcatcaataccaaaggaaggaccaagccgatgtgctacttgcaataaacgggttggtctgactggattcaaatgtcgctgcggtgacctcttctgcgggacgcaccgctatgcagacatacacaactgctccttcaattaccatgccgctgcgcaagaagctatagctaaagcaaacccggttgtgaaggcagagaagcttgacaaaatctgaagaactcaaacaccaaagtgatagactacgacctccttaggagcatttagaattggaaaagaaggtttagaattttacatatttgttattattgcctactaaggtgtttactcctataagagggagacatttgattctaataaaatcatccattaagagacc

SEQ ID NO: 570 - protein, 178 aa, Brassica napus
  misc_feature (1)..(178): Ceres Clone ID no. 1072112
  misc_feature (119)..(157): Pfam Name: zf-AN1 Pfam Description: AN1-like Zinc finger
  misc_feature (15)..(39): Pfam Name: zf-A20 Pfam Description: A20-like zinc finger
  misc_feature (1)..(178): Bit score of 266.0 for HMM based on sequences of Figure 3
  misc_feature (1)..(178): Functional Homolog Of SEQ ID NO. 451
MDHDKTGCQSPPEGPKLCINNCGFFGSSATMNMCSKCHKAILFQQEQGARFASAVSGGTSSSSNILKETFAATALVDAETKSVEPVAVSLQPSSVQVVVAEVVAPEAAASIPKEGPSRCATCNKRVGLTGFKCRCGDLFCGTHRYADIHNCSFNYHAAAQEAIAKANPVVKAEKLDKI

SEQ ID NO: 571 - DNA, 1010 bp, Glycine max
  misc_feature (1)..(1010): Ceres Clone ID no. 481246
  misc_feature (1)..(1010): Encodes the peptide sequence at SEQ ID NO. 572
  misc_feature (937)..(937): y is t/u or c
  misc_feature (943)..(943): y is t/u or c
acgcatccttctttctctctctctcctcctcgatcccaattccactagggattcaattccgatgcgattccgagcttgttagatccacgacaacgtttcgtttcccagattcttttgtaaaaaaaaataatcttcctttgcccaacaggtaagttggaaaaaaatggaccatgacaagactgggtgccaagctcctcctgaaggtcctatattgtgcatcaacaactgtggattttttggaagtgcagctaccatgaatatgtgttctaaatgccacaaagacatgttgctgaaacaggagcaggccaagcttgcagcatcatccattgggaatattatgaatgggtcttcaagcagcactgaaaaggaacctgttgttgccgctgctgctgctaatgttgatatcccagttattccagtagagcctaaaactgtctctgtgcaacctttatttggttcaggtccagaagggagtggtgaggcaaagctgaaggatggaccaaaacgctgcagcagctgcaacaagcgagttggtttgacagggtttaattgtcgatgtggtgaccttttttgtgctgtacatcgctactcagacaagcataattgcccatttgattaccgcactgctgctcgggatgccatagctaaagcaaacccagttgtcaaggctgagaagcttgataagatctaagatttgaagtcaaagtttcatggcctgagatgaagttatgcataatttcatcatgaaatgatccgagtttccttcacattttatttggtgttctgtagttatattgttatatgtggtgggtgacttggagttattggacatttctgcaatttgaaggactctttcatgtgattggcgaaaatatatatgttggccacagtgtttaagtttttaagtgctggtttggtgaaagttggttggtgttgytagctytgtaatgcatctatcctgtatcagaatggtatgtgcaatttaaagatggtttcaagagcatccgggg

SEQ ID NO: 572 - protein, 175 aa, Glycine max
  misc_feature (1)..(175): Ceres Clone ID no. 481246
  misc_feature (116)..(155): Pfam Name: zf-AN1 Pfam Description: AN1-like Zinc finger
  misc_feature (15)..(39): Pfam Name: zf-A20 Pfam Description: A20-like zinc finger
  misc_feature (1)..(175): Bit score of 309.2 for HMM based on sequences of Figure 3
  misc_feature (1)..(175): Functional Homolog Of SEQ ID NO. 451
MDHDKTGCQAPPEGPILCINNCGFFGSAATMNMCSKCHKDMLLKQEQAKLAASSIGNIMNGSSSSTEKEPVVAAAAANVDIPVIPVEPKTVSVQPLFGSGPEGSGEAKLKDGPKRCSSCNKRVGLTGFNCRCGDLFCAVHRYSDKHNCPFDYRTAARDAIAKANPVVKAEKLDKI

SEQ ID NO: 573 - DNA, 455 bp, Glycine max
  misc_feature (1)..(455): Ceres Clone ID no. 1242573
  misc_feature (1)..(455): Encodes the peptide sequence at SEQ ID NO. 574
attgattcgttgttcgtgagtctggcccgctaaaaccaaaaggaacaccgggttaaccattcttgatgtagaaaagtgaacggcagctgggaagctaaacgacggcgtggagtgatgatattggaggagatgttcttctgcagcagcagtagcagtagccagcagcttcaaccatttgaaaatccttcttccaatctactccttctctctggccctccttcttcgtatttcctctctctgaaaattgaatatgacatgacttgtttcaattcttaatgatccaattttacgttatacagtgggaagacttctcttcttttccaatttgcattcaatgtagcactgcactccgactcaaataacaaagtcatcttcatttgcaaccgccataggttggattccaaacccccttttctttctcagggtattgacccctcttctcatgtattccaccg

SEQ ID NO: 574 - protein, 174 aa, Glycine max
  misc_feature (1)..(174): Ceres Clone ID no. 1242573
  misc_feature (115)..(154): Pfam Name: zf-AN1 Pfam Description: AN1-like Zinc finger
  misc_feature (15)..(39): Pfam Name: zf-A20 Pfam Description: A20-like zinc finger
  misc_feature (1)..(174): Bit score of 305.0 for HMM based on sequences of Figure 3
  misc_feature (1)..(174): Functional Homolog Of SEQ ID NO. 451
MDHDKTGCQAPPEGPILCINNCGFFGSAATMNMCSKCHKDILLKQEQAKLAASSIGNIMNGSSSSTEKEPVVAAAANIDIPVIPVEPKTVSVQPLFGSGPEGSVEAKPKDGPKRCSSCNKRVGLTGFNCRCGDLFCAVHRYSDKHNCPFDYRTAAQDAIAKANPVVKAEKLDKI

SEQ ID NO: 575 - DNA, 1197 bp, Glycine max
  misc_feature (1)..(1197): Ceres Clone ID no. 537439
  misc_feature (1)..(1197): Encodes the peptide sequence at SEQ ID NO. 576
agaaatcgagagaaagagagagagaattacagagcattttccaacacgattacacgaccgaatcaaacccctctttctctccgaagctgcttttaatatcgtactggccttcgattgttctcctctttaatacatactgttctctcttcgatttgagggaacagtacaagagtctgagcatcggttaacccaactgcacaggttttaaactgccgtcatggtatcatcgtggtgttgcgggaaattgtggacaaatgtgcccgttgtggctgtaaattgtggttgtggagacttcaaaaaccttgatgttgctggccaaaattaaggtagtctccaaataatggagcctcatgatgagactggatgccaggctcctgaacgccccattctttgcattaataattgtggcttctttggaagagcagctaccatgaacatgtgttccaagtgttacaaggacatgctgttgaagcaggagcaggacaaatttgcagcatcatccgttgaaaacattgtgaatggcagttccaatggcaatggaaagcaggctgtggctactggtgctgttgctgtacaagttgaagctgtggaggtcaagattgtctgtgctcagagttctgtggattcgtcctccggtgatagtttggagatgaaagccaagactggtcccagtagatgtgctacatgccggaaacgtgttggtttaactggtttcagctgcaaatgtggcaacctcttctgtgcaatgcatcgctattctgataaacatgattgcccttttgattataggactgttggtcaggatgccatagctaaagccaaccccataattaaggcagataagctcgacaaaatctaggcatgcactactgaaggttaatgtatgaaccttgaagcttcatcttctatatgtaagtttcatatatgttgtcttcctggttttttaggtgtcctttagtgattaaaatgatccaagtcaagatggcaagggcatcattagggaaaacatttattgttggttgggagatccacttgttagctccagtgtgtttgtgctgctttgatggacactttggctcattttgtaatttgatttcctgcttggtctgcatttttcttcctcattgcatgaaaagtatttcctgcgtagtcttgtattggttttgcttttgaatcattataggaatgtttaatttc

SEQ ID NO: 576 - protein, 172 aa, Glycine max
  misc_feature (1)..(172): Ceres Clone ID no. 537439
  misc_feature (113)..(151): Pfam Name: zf-AN1 Pfam Description: AN1-like Zinc finger
  misc_feature (15)..(39): Pfam Name: zf-A20 Pfam Description: A20-like zinc finger
  misc_feature (1)..(172): Bit score of 291.8 for HMM based on sequences of Figure 3
  misc_feature (1)..(172): Functional Homolog Of SEQ ID NO. 451
MEPHDETGCQAPERPILCINNCGFFGRAATMNMCSKCYKDMLLKQEQDKFAASSVENIVNGSSNGNGKQAVATGAVAVQVEAVEVKIVCAQSSVDSSSGDSLEMKAKTGPSRCATCRKRVGLTGFSCKCGNLFCAMHRYSDKHDCPFDYRTVGQDAIAKANPIIKADKLDKI

SEQ ID NO: 577 - DNA, 1124 bp, Glycine max
  misc_feature (1)..(1124): Ceres Clone ID no. 547126
  misc_feature (1)..(1124): Encodes the peptide sequence at SEQ ID NO. 578
  misc_feature (243)..(243): r is g or a
  misc_feature (348)..(348): k is g or t/u
  misc_feature (362)..(362): k is g or t/u
  misc_feature (597)..(597): r is g or a
  misc_feature (818)..(818): y is t/u or c
gacgcatccttctctttctttcggctttgatttctctctcctcgactcgatcccaattccactagggttagggttccgttacccttttccccttctcaattcttgctttcctcttttaaccgctatcgttttcgtttattcattgatcattctttctcgttttcttctttttcggtgaatccaggattcaattccgatgcgattccgagcttgttagatccacgacaaggtttcgtttcccarattcttttgtaaaaaaaaattcttcctctgcccaacaggtaagttgtaaaaaaatggaccatgacaagactgggtgccaagctcctcctgaaggtcctatattgkgcatcaacaactgkgggttttttggaagtgcagctaccatgaacatgtgttctaaatgccacaaagacatattgctgaaacaggagcaggccaagcttgcagcatcatccattgggaatattatgaatgggtcatcaagcagcactgaaaaggaacctgttgttgctgctgctgctaatattgatatcccagttattccagtagagcctaaaactgtctctgtgcaacctttatttggttcaggtccaraggggagtgttgaggcaaagccgaaggatggaccaaaacgttgcagcagctgcaacaagcgagttggtttgacagggtttaattgtcgatgtggtgaccttttttgtgctgtacatcgctactcagacaagcataattgcccatttgattaccgcactgccgctcaagatgctatagctaaagcaaacccagttgtcaaggctgaaaagcttgataagatytaagatttgaagttgaagttccatgccctgagatgaagttatgcacaatttcatcatgaaatgatccgagtttccttcacattttattggtgttcttattatattgttatatgtggtgggtgacttgagttattggacatctctgcaatttgaaggactctttcatgtgattggtgaaaatatatatgttggccactgttgtttttaagtgctggtttggtgaaagttggttggtgttgttagctttgtaatgcatctattcttgtatcagaatggtatttgcaatttaaagatggtttcaagagc

SEQ ID NO: 578 - protein, 174 aa, Glycine max
  misc_feature (1)..(174): Ceres Clone ID no. 547126
  misc_feature (115)..(154): Pfam Name: zf-AN1 Pfam Description: AN1-like Zinc finger
  misc_feature (23)..(39): Pfam Name: zf-A20 Pfam Description: A20-like zinc finger
  misc_feature (1)..(174): Bit score of 279.0 for HMM based on sequences of Figure 3
  misc_feature (1)..(174): Functional Homolog Of SEQ ID NO. 451
  misc_feature (18)..(18): Xaa is any aa, unknown or other
  misc_feature (22)..(22): Xaa is any aa, unknown or other
  misc_feature (101)..(101): Xaa is any aa, unknown or other
  misc_feature (174)..(174): Xaa is any aa, unknown or other
MDHDKTGCQAPPEGPILXINNXGFFGSAATMNMCSKCHKDILLKQEQAKLAASSIGNIMNGSSSSTEKEPVVAAAANIDIPVIPVEPKTVSVQPLFGSGPXGSVEAKPKDGPKRCSSCNKRVGLTGFNCRCGDLFCAVHRYSDKHNCPFDYRTAAQDAIAKANPVVKAEKLDKX

SEQ ID NO: 579 - protein, 170 aa, Medicago truncatula
  misc_feature (1)..(170): Public GI ID no. 92896423
  misc_feature (12)..(35): Pfam Name: zf-A20 Pfam Description: A20-like zinc finger
  misc_feature (111)..(149): Pfam Name: zf-AN1 Pfam Description: AN1-like Zinc finger
  misc_feature (1)..(170): Bit score of 312.9 for HMM based on sequences of Figure 3
  misc_feature (1)..(170): Functional Homolog Of SEQ ID NO. 451
MAEEHRCQAAQRLCANNCGFFGSPAMQDLCSKCYRDLQMKEQRSSSAKLVLNQTLIPQQSNSSSLDTGIIHPSSTSPSVMIVSSSTPTVELVAAAAGPSEAEPPKVQPNRCGTCRRRVGLTGFKCRCGLTLCGTHRYPEQHGCGFDFKGMGREEIKKANPVVKGEKLNKI

SEQ ID NO: 580 - protein, 172 aa, Medicago truncatula
  misc_feature (1)..(172): Public GI ID no. 124360119
  misc_feature (113)..(152): Pfam Name: zf-AN1 Pfam Description: AN1-like Zinc finger
  misc_feature (15)..(39): Pfam Name: zf-A20 Pfam Description: A20-like zinc finger
  misc_feature (1)..(172): Bit score of 279.2 for HMM based on sequences of Figure 3
  misc_feature (1)..(172): Functional Homolog Of SEQ ID NO. 451
MESHDEMGCQAPERPILCVNNCGFFGREATMNMCSKCYKDTLLKQEQEKLVATSVENIVNGNSSSNGKLAVTASAVDVRVESVELNTVSPEVPENPISNESVEMKAKTGPSRCATCRKRVGLTGFSCKCGNLFCSMHRYSDKHDCPFDYRTAGQKAIAESNPVIKADKLDKI

SEQ ID NO: 581 - protein, 355 aa, Oryza sativa
  misc_feature (1)..(355): Public GI ID no. 122069751
  misc_feature (1)..(355): Oryza sativa Japonica Group
  misc_feature (295)..(334): Pfam Name: zf-AN1 Pfam Description: AN1-like Zinc finger
  misc_feature (202)..(226): Pfam Name: zf-A20 Pfam Description: A20-like zinc finger
  misc_feature (1)..(355): Bit score of 186.9 for HMM based on sequences of Figure 3
  misc_feature (1)..(355): Functional Homolog Of SEQ ID NO. 451
MGQQVQHESRINVGEATHVSKAEMGANTMFATSRLNSNNKVGPELAYLSGVASSASDSSTAAPSPCYLCHKPAALHVFGLAGRYVFGSVKREAYLSQEGPRSGRTPNRIAESLPVRVVNDFGLRLRVVTNQGPIKPRPPRPIDAIVFASIETRNRLRGFDRSFCCSAPPETYVFLPRARETIVLRANIIKMSSEQQASAGQPVLCASGCGFYGNPATLDMCSVCYRQHCLLNGATMATGPSSSVAAASAATVATGAVTSDSCSVPSAEVNGAAFSSKNNPEPATVVEKKAPANRCASCKKKVGLLGFACRCGATYCGTHRYPEKHACGFDFKGASRDAIARANPLIKGEKLTNKI

SEQ ID NO: 582 - DNA, 951 bp, Brassica napus
  misc_feature (1)..(951): Ceres Clone ID no. 1030374
  misc_feature (1)..(951): Encodes the peptide sequence at SEQ ID NO. 583
gaaactcagaaaagcagagaactttattctctcctctaacctctcaacttctgctggatctctccagcagacggaagatcttcttcggagagattcttaggggaccgaacgatctatcgatcaaggcttctcgggcaaacagaagtgcagaaatggaccacgacaagacaggatgccaaagcccacccgagggtcccaagctatgcatcaacaactgcggtttcttcggaagcgctgccacaatgaacatgtgttccaagtgccacaagactatcttgtttcaacaggaacagggggccaagcttgcatctgcagtgtctggatcacccagcaacatcctaaaggaaaccttcactgctgatttggttgatgctggaaccaaatccatcgagcctgtggctgtctctgtacaagctgttgcagaggtagtagcaccagaagaagctgcagcaaaaccaaaggaagggcccagccgatgtactacttgcaacaaacgggttggtttgactggattcaaatgtcgatgtggtgacctcttctgtggtacgcaccgctatgcagacgttcataactgctctttcgattaccatgttgctgcgcaagaagctatagccaaagcgaacccggttgtgaaggcagataagcttgacaagatctgaaactcagaaactatgtttccttcttcatgtccgtgtctggttcaagcgtgtgttgatctttagcttcttccgttctctctgccagtatctgtggtgtgaaaactttctatattatcttgtgtttgcaagcagagaagtgtgctcttaaatatatatatatgctttgatgtgtttctctttttttttttttaatattatttatgagcactatggtttggttatgtttactcctttgggtctgtatcatattgagattgtaactttagctatatgaagatttttcttaaaagct

SEQ ID NO: 583 - protein, 168 aa, Brassica napus
  misc_feature (1)..(168): Ceres Clone ID no. 1030374
  misc_feature (109)..(146): Pfam Name: zf-AN1 Pfam Description: AN1-like Zinc finger
  misc_feature (15)..(39): Pfam Name: zf-A20 Pfam Description: A20-like zinc finger
  misc_feature (1)..(168): Bit score of 275.1 for HMM based on sequences of Figure 3
  misc_feature (1)..(168): Functional Homolog Of SEQ ID NO. 451
MDHDKTGCQSPPEGPKLCINNCGFFGSAATMNMCSKCHKTILFQQEQGAKLASAVSGSPSNILKETFTADLVDAGTKSIEPVAVSVQAVAEVVAPEEAAAKPKEGPSRCTTCNKRVGLTGFKCRCGDLFCGTHRYADVHNCSFDYHVAAQEAIAKANPVVKADKLDKI

SEQ ID NO: 584 - DNA, 862 bp, Brassica napus
  misc_feature (1)..(862): Ceres Clone ID no. 1030540
  misc_feature (1)..(862): Encodes the peptide sequence at SEQ ID NO. 585
gattaagattcactttttattccgatagatcagattcatttcctgaatctgttatataaaattctttctaaagaggaagaaatctcacggttccaacaggaaaaatgggttctgaacagaatgatagcacgagcttcacacaatcatcagagccgaaactttgtgcaaacggatgtggtttctttggttcgccatcaaacatggatctgtgttcgaaatgctaccgagacatatgcgcagaggaagctcaaacagctgttgcaaaagctgccgttgagaaatctttcaagccatcgccatcgcctcctcctcctaccctcttcatagcagagcctgatgtggcgaaaccagagaaagaaaaggcggttgctactgttcttgtggtggccgagccatcttctgcaacaggagaagctacagttcctgaacagaacgaaccaccatctaaacctgcacggccgaaccggtgcctttgttgcaacaagaaggttggtatacttgggtttaagtgcaaatgcgggagcactttctgcggcgaacatcggtaccctgagagacatgattgcagctttgatttcaaagaagctgggcgtggagagattgcaaaagccaatccggttattaaagctgataaacttcaaaggttctgagaaaggctacggtgttggtctctcttttcttttatctcaaattgtatttgaatggaattgggtttctactagtggattgtttccaaaggggggtaacatgatgaatttggttctttaataaactcagtcatctctatttcatgctattcaggtacggattataatctttgtgggtaacttgtaaaatcaatttatcaaagcttcttttggcc

SEQ ID NO: 585 - protein, 181 aa, Brassica napus
  misc_feature (1)..(181): Ceres Clone ID no. 1030540
  misc_feature (122)..(161): Pfam Name: zf-AN1 Pfam Description: AN1-like Zinc finger
  misc_feature (17)..(41): Pfam Name: zf-A20 Pfam Description: A20-like zinc finger
  misc_feature (1)..(181): Bit score of 225.6 for HMM based on sequences of Figure 3
  misc_feature (1)..(181): Functional Homolog Of SEQ ID NO. 451
MGSEQNDSTSFTQSSEPKLCANGCGFFGSPSNMDLCSKCYRDICAEEAQTAVAKAAVEKSFKPSPSPPPPTLFIAEPDVAKPEKEKAVATVLVVAEPSSATGEATVPEQNEPPSKPARPNRCLCCNKKVGILGFKCKCGSTFCGEHRYPERHDCSFDFKEAGRGEIAKANPVIKADKLQRF

SEQ ID NO: 586 - DNA, 807 bp, Triticum aestivum
  misc_feature (1)..(807): Ceres Clone ID no. 634261
  misc_feature (1)..(807): Encodes the peptide sequence at SEQ ID NO. 587
aaccaaacgcaatatcgccctgcccctccctcttcctcgtcgacgcgcaggccccagggaaattctccgttggagaaaagtcgcgtgccgtctctcgcccacagcccgttggcagcaatggcacaagagagctggaaggagtctgaggagactgtccaaacacctgaggcaccaatattgtgtgtaaacaactgcggcttcttcggtagcagcatgacaaacaacatgtgctccaagtgctacagggacttcattaaggccacgacaatggctgcccctgtagtggagaagaaggtgttctcagtggcatcatcttccagtgtgacattggagcaagcaaaggcagatgaagtaccagccgtggctgtagctgatagccaagcagcacaggagcctccaaagccgcccagcaacagatgcctttcatgccgcaagaagataggcttgaccggtttccagtgccggtgcgggggaacattctgctccatgcaccgctacgctgactcccacgaatgcactttcgactacaagaaggctggccgggagcagattgccaagcagaaccctgttgtgatagccaagaagatcaacaagatataattgataatgacaccgggttcatttgcttgctattcgtggtggtgctggattcgtctttacttgaatcagtaggtttcttctggtctggttgctagggtctcaattgtgtctatccttctccttcatggttcgcttctctccattaagaatgaaatgaaataatgtaaatatataatattatattgttttagctgttcgtttcgtatg

SEQ ID NO: 587 - protein, 160 aa, Triticum aestivum
  misc_feature (1)..(160): Ceres Clone ID no. 634261
  misc_feature (19)..(43): Pfam Name: zf-A20 Pfam Description: A20-like zinc finger
  misc_feature (101)..(140): Pfam Name: zf-AN1 Pfam Description: AN1-like Zinc finger
  misc_feature (1)..(160): Bit score of 321.3 for HMM based on sequences of Figure 3
  misc_feature (1)..(160): Functional Homolog Of SEQ ID NO. 451
MAQESWKESEETVQTPEAPILCVNNCGFFGSSMTNNMCSKCYRDFIKATTMAAPVVEKKVFSVASSSSVTLEQAKADEVPAVAVADSQAAQEPPKPPSNRCLSCRKKIGLTGFQCRCGGTFCSMHRYADSHECTFDYKKAGREQIAKQNPVVIAKKINKI

SEQ ID NO: 588 - DNA, 943 bp, Triticum aestivum
  misc_feature (1)..(943): Ceres Clone ID no. 696374
  misc_feature (1)..(943): Encodes the peptide sequence at SEQ ID NO. 589
gtccctggtgacgcccccaatcgagccgagctcctcgcgattcccaatccccgcacgcctcctcctccggccccgccgccgcctcgccacaggctttacagttattcaagatggaacacaaggaggcgggttgccagcagccggagggcccaatcctatgtgttaataactgtggcttctttggcagcgccgcgaccatgaacatgtgctccaagtgccacaaggagatggtcatgaaggaggagcaggccaagctggctgcctcctccttcgatagcatcgtcaacggtggcgatggtgggaaagcacctgttgttgcggctgtggccgcgagcgcagaggtggcggttgctcaagttgacgtgaaggcgcttgttgtgcagcctgctgctgatgttgcaggcaccagcgaagctgttgccgtgagccccaagaggaaggaggggccgaatcggtgctcaacttgcaggaagagggttgggctgacgggattcaactgccgatgcggtaacatgtactgttcactgcatcgctattccgacaagcatgactgccagttcgactaccggactgcagctagggatgccatcgccaaggccaacccggtggtgaaggcagagaagctcgacaagatttaggtgtcctacagggaagaaatggttgcaatctgccaaggttcatcatccgtctttgcagtgccatccttgcacctccctttcttgttggctgccgcatttcctaaattgtacggcatcgtgatgcacactgcgtcgtggcggctgcaagaactcaatcctcagtattgtggtttgcgtgttgtgtaactttattcatggtggttttttcggtcagtattgtggcttctcattttagctagctctgttatgtactattgtcccatgtgtgttaaattctgatcagtaatagtagccagcaatggttc

SEQ ID NO: 589 - protein, 175 aa, Triticum aestivum
  misc_feature (1)..(175): Ceres Clone ID no. 696374
  misc_feature (116)..(155): Pfam Name: zf-AN1 Pfam Description: AN1-like Zinc finger
  misc_feature (14)..(38): Pfam Name: zf-A20 Pfam Description: A20-like zinc finger
  misc_feature (1)..(175): Bit score of 354.2 for HMM based on sequences of Figure 3
  misc_feature (1)..(175): Functional Homolog Of SEQ ID NO. 451
MEHKEAGCQQPEGPILCVNNCGFFGSAATMNMCSKCHKEMVMKEEQAKLAASSFDSIVNGGDGGKAPVVAAVAASAEVAVAQVDVKALVVQPAADVAGTSEAVAVSPKRKEGPNRCSTCRKRVGLTGFNCRCGNMYCSLHRYSDKHDCQFDYRTAARDAIAKANPVVKAEKLDKI

SEQ ID NO: 590 - DNA, 897 bp, Triticum aestivum
  misc_feature (1)..(897): Ceres Clone ID no. 698573
  misc_feature (1)..(897): Encodes the peptide sequence at SEQ ID NO. 591
gccccccatttcgaagcccaccgaattcctcgcgattcctctcccctcgcctcctcgtcctccccctcctaggggatcgccggagaggaatcgcgacgagggcttcctcctatcagttaaatcaaagccatggagcacaaggagaccggctgccagtctcgggagggccccatcctttgcgtcaataattgtggcttcttcggcagcgcggcgaccatgaacatgtgctccaagtgccacaaggagatggcgatgaagcaggagcaggcaaagctggccgcctcctctttcgacagcatcgtcaacggtggcgatgccgcgaaagaacatcttgctgctggcagcacggcggtggcagttgctcacgttgaggcgaagacgcttattaccgcacagcctgctgatatcgctggtccaagcgagggggcgatggagaaccccaaaggcccaagccggtgcagcacctgcagaaagagggtcgggctgaccggattcaactgccggtgtgggaacctgtactgcgcaacgcaccgttactcggacaagcacgagtgcaagtttgactaccgcgccgcggccatggacgccatcgccaaggccaacccagtggtgaaggcggagaagcttgacaagatctaggaagggtcccccctacggtcggcagaacataaggtcccaaatcaaatctgcgctacctcgtcatcgtgcgtcttgctgcattatcctttcatcatgttggcttctgcaatcttagttgttgggcaatcgtgatgcatggcacacgcgcctcggcggcagccccaggtccgaacggtctccttgttggctatgttgtgtaagctttatttatggtcgtctctctgcgcggcggaacgggaacggtattgtggctttcgc

SEQ ID NO: 591 - protein, 169 aa, Triticum aestivum
  misc_feature (1)..(169): Ceres Clone ID no. 698573
  misc_feature (14)..(38): Pfam Name: zf-A20 Pfam Description: A20-like zinc finger
  misc_feature (110)..(148): Pfam Name: zf-AN1 Pfam Description: AN1-like Zinc finger
  misc_feature (1)..(169): Bit score of 319.2 for HMM based on sequences of Figure 3
  misc_feature (1)..(169): Functional Homolog Of SEQ ID NO. 451
MEHKETGCQSREGPILCVNNCGFFGSAATMNMCSKCHKEMAMKQEQAKLAASSFDSIVNGGDAAKEHLAAGSTAVAVAHVEAKTLITAQPADIAGPSEGAMENPKGPSRCSTCRKRVGLTGFNCRCGNLYCATHRYSDKHECKFDYRAAAMDAIAKANPVVKAEKLDKI

SEQ ID NO: 592 - DNA, 875 bp, Triticum aestivum
  misc_feature (1)..(875): Ceres Clone ID no. 701370
  misc_feature (1)..(875): Encodes the peptide sequence at SEQ ID NO. 593
tatgtatgtttcttggcaagcatagcaattgatcatcgattcgcacaaggtctctcgaaatggcgcaagagagttggaaagaggcagaggatacgggtgtccacgcgcccgaggctccgataatgtgcatcaacaactgtggcttcttcgggaaccggatgacagagaacatgtgctcaaagtgttaccgagacactgtcaaggccaagagcatggcccttctagttgagaacaaaactgccgctgctgttgcatcgtcacccacaccaatggtggcagagatcaaggatgaagcgtctgcctcagccaaagaaggaaaacgagtagccgaggaagaggcgccgaagccacccagcaaccgctgcctgtcgtgccggaagaaggtcgggctgacggggttcaagtgccgctgcggagacaccttctgctcgatgcaccgctacgccgacgcgcacgattgcaagttcgactacaagcaggccggcagggagcagatcgcccagcagaacccggtcgtcaaggctgacaaggtcaccagattctgatggaggttctgctgcaggagccctccagctcgtttattccctctatgatgatgatgatgatgcttggtccgtcaggtttacttcagaattgtgtgtctaccatcctcctggaatgtactttgccgatgaacccgccttcgacaaacaccaccaaccgatgtccgtccgacggccatcaacgggccattgcgccgggctggccgcgccttcaagggctgtataatgttggtgtttgtgtgggaggaacattcattggcacaggtgcacttctgtttatttacatatgaataatgcgaatgtaaatatttatcctttaacagtatgcagtcc

SEQ ID NO: 593 - protein, 161 aa, Triticum aestivum
  misc_feature (1)..(161): Ceres Clone ID no. 701370
  misc_feature (20)..(44): Pfam Name: zf-A20 Pfam Description: A20-like zinc finger
  misc_feature (102)..(141): Pfam Name: zf-AN1 Pfam Description: AN1-like Zinc finger
  misc_feature (1)..(161): Bit score of 277.2 for HMM based on sequences of Figure 3
  misc_feature (1)..(161): Functional Homolog Of SEQ ID NO. 451
MAQESWKEAEDTGVHAPEAPIMCINNCGFFGNRMTENMCSKCYRDTVKAKSMALLVENKTAAAVASSPTPMVAEIKDEASASAKEGKRVAEEEAPKPPSNRCLSCRKKVGLTGFKCRCGDTFCSMHRYADAHDCKFDYKQAGREQIAQQNPVVKADKVTRF

SEQ ID NO: 594 - DNA, 908 bp, Triticum aestivum
  misc_feature (1)..(908): Ceres Clone ID no. 893059
  misc_feature (1)..(908): Encodes the peptide sequence at SEQ ID NO. 595
  misc_feature (518)..(518): y is t/u or c
  misc_feature (635)..(635): y is t/u or c
  misc_feature (699)..(699): y is t/u or c
  misc_feature (718)..(718): s is g or c
  misc_feature (727)..(727): r is g or a
  misc_feature (750)..(750): y is t/u or c
acacccacgcccatccaattctcctctcctcgacctcccgatctctcccagaccacccacctcccggccgccgccgaggacgcccggacctcccggccggcagcaaaccaaccagccacctcgtgcgtgtttgaaaaatcatggcgcagcgggatcacaagcaggaggagcccacggagctgcgggcgccggagatcacgctctgcgccaacagctgcggcttcccgggcaacccggccacgcagaacctctgccagaactgcttcttggccggcccggcgtccacgtcgccgtcttcctcctcctcctcctcctcttctctgccgggcgtgtccgcgccgacccccgtcatcgacaggccgaggccggcgccgttggaggcggagctggcacgccccgccgtcgaccttgctccggcgacggaggcgaagccggcgaggacgtcggtgaaccggtgctccagctgccggaagcgcgtggggctgacggggttccggtgccggtgcggcgacatgttytgcggcgagcaccggtactcggaccggcacgggtgcagctacgactacaaggccgccgccagggacgccatcgccagggacaaccccgtcgtgcgcgccgccaagatcgtcaggttytgaagctgaaaccaaggggaaagaagaattcataattccagccgaggcaaagcaaagaatcatytcatcgaggcagtgggccsccgtgcgarccgctagtattatgctgttgttytccggagtgtttccctttttaattaaaaaaatctttatttattggaaggaaaaaaatgggaggtaaagatgtggatgaaaaggaaagaatagcgtgtgtgatgtaatatcaacgggtggttgaggcggaggagcaagcaatgaaatggattggatgtg

SEQ ID NO: 595 - protein, 165 aa, Triticum aestivum
  misc_feature (1)..(165): Ceres Clone ID no. 893059
  misc_feature (106)..(145): Pfam Name: zf-AN1 Pfam Description: AN1-like Zinc finger
  misc_feature (21)..(42): Pfam Name: zf-A20 Pfam Description: A20-like zinc finger
  misc_feature (1)..(165): Bit score of 184.9 for HMM based on sequences of Figure 3
  misc_feature (1)..(165): Functional Homolog Of SEQ ID NO. 451
  misc_feature (126)..(126): Xaa is any aa, unknown or other
  misc_feature (165)..(165): Xaa is any aa, unknown or other
MAQRDHKQEEPTELRAPEITLCANSCGFPGNPATQNLCQNCFLAGPASTSPSSSSSSSSSLPGVSAPTPVIDRPRPAPLEAELARPAVDLAPATEAKPARTSVNRCSSCRKRVGLTGFRCRCGDMXCGEHRYSDRHGCSYDYKAAARDAIARDNPVVRAAKIVRX

SEQ ID NO: 596 - DNA, 967 bp, Triticum aestivum
  misc_feature (1)..(967): Ceres Clone ID no. 757664
  misc_feature (1)..(967): Encodes the peptide sequence at SEQ ID NO. 597
gcctcgcctcctcctcctccgccccattcccccaaagcctcgactcgctcgctcgatcccgtctcctgcccacgcccggcctcccccgaggagatcaggccaccgtgcggtgcagacagggctcgccggccgtcctcgcgcgcgcgggaccgtctagcgtctctcggctcgtaggcgtcatggcgcagcgggacaagaaggtggaggagccgacggaggtgcacctgcacgccgcggagatcacgctctgcgccaacagctgcggcttcccgggcaacccggccaccaagaacctctgccagaactgcttcctggcgtcctcctcctcctcgccgtcctcctccgccgcctcaccgccgtccccttcctcctcgcccgcggccgcgttcccgctcttcgacaagccgaggccggccgccgccgcgtcgccggccgcgcccgtctacatggccgttgaccggcctgccgccgggccggcggacccgaaggcgtctaagtcgtcggtgaaccgctgccacaactgccggaagcgcgtgggcctgacggggttccgctgccggtgcggcgagatgttctgcggcgcgcaccggtactcggaccggcacgactgcagctacgactacaagtcggcggccagggacgccatcgcccgggagaaccccgtcgtgcgcgccgccaagatcgtccggttctgatcaccacgactacaaatccgaagcagcagagcccactcttttcctttctttcctttgaaaaaattaaaggcgtccccgagagtttcaaaaaaaaggagaggaaggtgggtgaaagatggcgatggggcggccacgacgaagaaacagtgcgatgataaggttgttgttgtagcggtggttggcggtggagggaagagaggagatgaggaagatggggttggtgtgtactgttgtcccacgatctctatttaattcaaatttccctattgtac

SEQ ID NO: 597 - protein, 171 aa, Triticum aestivum
  misc_feature (1)..(171): Ceres Clone ID no. 757664
  misc_feature (112)..(151): Pfam Name: zf-AN1 Pfam Description: AN1-like Zinc finger
  misc_feature (23)..(44): Pfam Name: zf-A20 Pfam Description: A20-like zinc finger
  misc_feature (1)..(171): Bit score of 175.4 for HMM based on sequences of Figure 3
  misc_feature (1)..(171): Functional Homolog Of SEQ ID NO. 451
MAQRDKKVEEPTEVHLHAAEITLCANSCGFPGNPATKNLCQNCFLASSSSSPSSSAASPPSPSSSPAAAFPLFDKPRPAAAASPAAPVYMAVDRPAAGPADPKASKSSVNRCHNCRKRVGLTGFRCRCGEMFCGAHRYSDRHDCSYDYKSAARDAIARENPVVRAAKIVRF

SEQ ID NO: 598 - DNA, 870 bp, Brassica napus
  misc_feature (1)..(870): Ceres Clone ID no. 1387149
  misc_feature (1)..(870): Encodes the peptide sequence at SEQ ID NO. 599
aaaaacaggttaacaacaacacatacacatctctctctctctctcttcttcgttttatatttccattctttttcttcatttccgccatttctgttttattttggttgccgagaaaacgcaggaactcggtgacctaattatagtctcgtcgattgtctttttcagaattttcgacgaattttattgattaataattaattaatggcggaagaacatccatgtcagacgccggaaggccaccgtctctgcgttaacaactgcggtttcttcggaagctcagccaccatgaatctctgctccaactgctacggcgacctctgcctcaagaaccagcagcaagcttccatgaaatcaaccgtcgagtcctccctctccgccgcatctcctccgtcgtcaccggagatccagtcaatctccacgtcgacgatcgcgcccgtcgtccaaatttacgcggcggagatacagatagagaaacaaatccagcagcaacggcctaatcggtgcaccgtgtgcaggaaacgggtcgggttaaccgggttcatgtgccggtgcgggacgactttctgcgggacccacaggtatccggaggttcacggatgcacgttcgatttcaaatcggctgggcgcgaggagatcgcgaaggctaacccgttggttgtagccgcgaagctccagaagatatgatctgagccgttgcttgcgttgttcaccgtgaaacatacttttatgttacggacatgtgtttacgtaattaatggttgagacagttttcattcaccttttaattattttccttttcttccggaagaattttaaagttttataattgtgtggctttgtgcttgtaaaaaaaaagattttcttttgcgg

SEQ ID NO: 599 - protein, 160 aa, Brassica napus
  misc_feature (1)..(160): Ceres Clone ID no. 1387149
  misc_feature (101)..(140): Pfam Name: zf-AN1 Pfam Description: AN1-like Zinc finger
  misc_feature (14)..(36): Pfam Name: zf-A20 Pfam Description: A20-like zinc finger
  misc_feature (1)..(160): Bit score of 378.3 for HMM based on sequences of Figure 3
  misc_feature (1)..(160): Functional Homolog Of SEQ ID NO. 451
MAEEHPCQTPEGHRLCVNNCGFFGSSATMNLCSNCYGDLCLKNQQQASMKSTVESSLSAASPPSSPEIQSISTSTIAPVVQIYAAEIQIEKQIQQQRPNRCTVCRKRVGLTGFMCRCGTTFCGTHRYPEVHGCTFDFKSAGREEIAKANPLVVAAKLQKI

SEQ ID NO: 600 - DNA, 960 bp, Brassica napus
  misc_feature (1)..(960): Ceres Clone ID no. 1411371
  misc_feature (1)..(960): Encodes the peptide sequence at SEQ ID NO. 601
acaaatattcgatttttcagcagcgtcgtctctgtttccatcttctttctctttcttctcccttcccgatttcatcgttaattggtaaagaaaaaaagtcagtgaatcatctctcttcttcttcttcttctctcaagaacaggttttcggtttaaagcctcgaaattctctatggcggaagagcatcgatgtcagacgccggaaggccaccgtctctgtgctaacaactgcggcttcctcggcagctccgccaccatgaatctatgctccaactgctacggcgatctctgccttaagcaacagcaagcttccatgaaatccaccgtcgaatcctctctctccgccgtatctcctccgtcgtcagagatcggttctatgcaatccaccgttgaatcctctctctccgacgtatctcctccatcatcggagaccatttccatctcttctccaatgatccagcctctcgttcgaaacccatcagctgaactggaggtaacggcgaagaacgttccgaagacggtgactccgccgccggagcagcagcagaaacggccgaatcggtgcacgacgtgtaggaaacgggtcgggttgactgggttcaagtgccggtgcggaacgactttttgcggggctcacaggtacccggaggtccatggatgcaccttcgatttcaaatcggccggtcgcgaagagatcgccaaggcgaacccactcgtcaaagcggcgaagcttcagaagatttgatcgccgccgttcgatgcgttgacttttaaaccatcatttgaacgcgtttgtctcccccagaaatggtgttagattgatctcagccgttcatgatgtgtcattatgtaaaagatatgtactacgaaggacacgtgtcacgtgacgttttcctcatcttcccaattaattttcttttccccttaaagaaataagattattcgcgttggcttttctctc

SEQ ID NO: 601 - protein, 190 aa, Brassica napus
  misc_feature (1)..(190): Ceres Clone ID no. 1411371
  misc_feature (131)..(170): Pfam Name: zf-AN1 Pfam Description: AN1-like Zinc finger
  misc_feature (14)..(36): Pfam Name: zf-A20 Pfam Description: A20-like zinc finger
  misc_feature (1)..(190): Bit score of 361.2 for HMM based on sequences of Figure 3
  misc_feature (1)..(190): Functional Homolog Of SEQ ID NO. 451
MAEEHRCQTPEGHRLCANNCGFLGSSATMNLCSNCYGDLCLKQQQASMKSTVESSLSAVSPPSSEIGSMQSTVESSLSDVSPPSSETISISSPMIQPLVRNPSAELEVTAKNVPKTVTPPPEQQQKRPNRCTTCRKRVGLTGFKCRCGTTFCGAHRYPEVHGCTFDFKSAGREEIAKANPLVKAAKLQKI

SEQ ID NO: 602 - DNA, 914 bp, Zea mays
  misc_feature (1)..(914): Ceres Clone ID no. 1380920
  misc_feature (1)..(914): Encodes the peptide sequence at SEQ ID NO. 603
  misc_feature (42)..(42): m is a or c
ccccccccccccctgggggttttttttaaaagctggagctcmccgcggtggcggccgctctagaactagtggatcccccgggctgcaggaattcgcacgagaccattacctagaacatcctaatcgaaaaattaagattcactttttattccgatagatcagattcatttcctgaatctgttatataaaattctttctaaagaggaagaaatctcacggttccaacaggaaaaatgggttctgaacagaatgatagcacgagcttcacacaatcatcagagccgaaactttgtgcaaacggatgtggtttctttggttcgccatcaaacatggatctgtgttcgaaatgctaccgagacatatgcgcagaggaagctcaaacagctgttgcaaaagctgccgttgagaaatctttcaagccatcgccatcgcctcctcctcctaccctcttcatagcagagcctgatgtggcgaaaccagagaaagaaaaggcggttgctactgttcttgtggtggccgagccatcttctgcaacaggagaagctacagttcctgaacagaacaaaccaccatctaaacctgcacggccgaaccggtgcctttgttgcaacaagaaggttggtatacttgggtttaagtgcaaatgcgggagcactttctgcggcgaacatcggtaccctgagagacatgattgcagctttgatttcaaagaagctgggcgtggagagattgcaaaagccaatccggttattaaagctgataaacttcaaaggttctgagaaaggctacggtgttggtctctcttttcttttatctcaaattgtatttgaatggaattgggtttctactagtggattgtttccaaaggggggtaacatgatgaatttggttctttaataaactcagtcatctct

SEQ ID NO: 603 - protein, 181 aa, Zea mays
  misc_feature (1)..(181): Ceres Clone ID no. 1380920
  misc_feature (122)..(161): Pfam Name: zf-AN1 Pfam Description: AN1-like Zinc finger
  misc_feature (17)..(41): Pfam Name: zf-A20 Pfam Description: A20-like zinc finger
  misc_feature (1)..(181): Bit score of 225.9 for HMM based on sequences of Figure 3
  misc_feature (1)..(181): Functional Homolog Of SEQ ID NO. 451
MGSEQNDSTSFTQSSEPKLCANGCGFFGSPSNMDLCSKCYRDICAEEAQTAVAKAAVEKSFKPSPSPPPPTLFIAEPDVAKPEKEKAVATVLVVAEPSSATGEATVPEQNKPPSKPARPNRCLCCNKKVGILGFKCKCGSTFCGEHRYPERHDCSFDFKEAGRGEIAKANPVIKADKLQRF

SEQ ID NO: 604 - DNA, 883 bp, Brassica napus
  misc_feature (1)..(883): Ceres Clone ID no. 1360570
  misc_feature (1)..(883): Encodes the peptide sequence at SEQ ID NO. 605
aacctaaattaagggatttgttctaacaaatctctctagaatccaaaagtaagaatcccgtctctctctcatcttcttctcgggaagatcagaaaacagctttttgtgaaattccatccccaagctttgaagatcgcaggaaaattctcgttttgatctgaccgtttctggtgaagaagacaggattctaaaagacaacaacaatgagctctgagcaaaacaacagcacaagcttcccaccaacagagccaaagctctgcgacaacgggtgcggattcttcgggtcaccctccaacatgaacctctgttccaaatgttaccgaagcctacgtgccgaggaagatcaaaccgcagttgcaaaagctgcggtggagaaatcacttaagcttccatcttgcaatctcatcaccgcaccagagccaaaacagcctctggagaccaaaccagcctcgttggaaaccgttgtgattgctgggacgtcttctgttcctcctgtagctacgggacaggacgagggagagccttcgaaacccacacggccgaacaggtgtttcagctgtaacaagaaggttggagttatggggttcaagtgcaagtgcggtagcacgttttgcgggagccataggtacccggagaagcatgagtgtagcttcgatttcaaagaggttggacgcggtgcaatcgcaaaggcgaatcctgtggtcaaggcggataaagtccagaggatttgatttgatgtgatgtgatctgtctatctttcagtttattccgagaatgttgatgtgatgtggtcatgttccatgttgggtttctatgaatcaaaatgaaaattgctgctattggttttctcatgaatcctttttagtgctttttaagtctattg

SEQ ID NO: 605 - protein, 175 aa, Brassica napus
  misc_feature (1)..(175): Ceres Clone ID no. 1360570
  misc_feature (116)..(154): Pfam Name: zf-AN1 Pfam Description: AN1-like Zinc finger
  misc_feature (17)..(40): Pfam Name: zf-A20 Pfam Description: A20-like zinc finger
  misc_feature (1)..(175): Bit score of 216.6 for HMM based on sequences of Figure 3
  misc_feature (1)..(175): Functional Homolog Of SEQ ID NO. 451
MSSEQNNSTSFPPTEPKLCDNGCGFFGSPSNMNLCSKCYRSLRAEEDQTAVAKAAVEKSLKLPSCNLITAPEPKQPLETKPASLETVVIAGTSSVPPVATGQDEGEPSKPTRPNRCFSCNKKVGVMGFKCKCGSTFCGSHRYPEKHECSFDFKEVGRGAIAKANPVVKADKVQRI

SEQ ID NO: 606 - DNA, 593 bp, Brassica napus
  misc_feature (1)..(593): Ceres Clone ID no. 1458498
  misc_feature (1)..(593): Encodes the peptide sequence at SEQ ID NO. 607
acatagcttctctccatctctgcatctgttcttcgattcaaagtttgtgtctttttcttcctccaataggttttttgtagattttcgataatgggttcagagcaaaacgacagcttctccccttcagagccgaagctctgcgtcaacggctgcggcttcttcggatcaccatcgaacatgaacctctgctccaagtgctaccgcgacatcagagccaccgaggagcaagccgcctccgctaaagccgccgtcgacaaatctctaaaccctaacaaacctcacaccaaaccaccgcaacagagcctggagaccgctcccgagccatcctcgtcggcgagcgtcggagattcctcggatccgccgagagcgacgagatgcttgagctgtaacaagaaggtgggcgttacggggttcaagtgccggtgcgggagcactttctgtggagcccacaggtacccggagagccacgactgcgagtttgatttcaaaggagcggctagagaggctattgctaaggcgaatcctgtggtgaaagctgataaggtggagaagatatgattttgaagatggaatcgtgtttctcttttcgagtg

SEQ ID NO: 607 - protein, 155 aa, Brassica napus
  misc_feature (1)..(155): Ceres Clone ID no. 1458498
  misc_feature (96)..(134): Pfam Name: zf-AN1 Pfam Description: AN1-like Zinc finger
  misc_feature (14)..(38): Pfam Name: zf-A20 Pfam Description: A20-like zinc finger
  misc_feature (1)..(155): Bit score of 249.2 for HMM based on sequences of Figure 3
  misc_feature (1)..(155): Functional Homolog Of SEQ ID NO. 451
MGSEQNDSFSPSEPKLCVNGCGFFGSPSNMNLCSKCYRDIRATEEQAASAKAAVDKSLNPNKPHTKPPQQSLETAPEPSSSASVGDSSDPPRATRCLSCNKKVGVTGFKCRCGSTFCGAHRYPESHDCEFDFKGAAREAIAKANPVVKADKVEKI

SEQ ID NO: 608 - protein, 174 aa, Zea mays
  misc_feature (1)..(174): Public GI ID no. 60202503
  misc_feature (115)..(154): Pfam Name: zf-AN1 Pfam Description: AN1-like Zinc finger
  misc_feature (14)..(38): Pfam Name: zf-A20 Pfam Description: A20-like zinc finger
  misc_feature (1)..(174): Bit score of 345.3 for HMM based on sequences of Figure 3
  misc_feature (1)..(174): Functional Homolog Of SEQ ID NO. 451
MEHKEAGCQAPEGPILCINNCGFFGSAATMNMCSKCHKEMITKQDQAKLAASSIDSIVNGSDAVMEPVVAGSNTVVAVAQVELQTMNVQQPADVAGPSEGVAAISKGGKVGPNRCSACRKRVGLTGFNCRCGNLYCALHRYSDKHDCKFDYRTAARDAIAKANPVVKADKLDKI

SEQ ID NO: 609 - DNA, 991 bp, Zea mays
  misc_feature (1)..(991): Ceres Clone ID no. 1554153
  misc_feature (1)..(991): Encodes the peptide sequence at SEQ ID NO. 610
ggtctcccccaccatccgtggcccgacgacgtccccatttccaagctcctcctcgcgattccaatccacgcacgcctcctccgcttccgcctcgctcaggcttatagtcagtgatggaacacaaggaggcgggctgccagcagccggagggcccaatcctatgcatcaataactgcggcttcttcggcagtgctgcgacgatgaacatgtgctccaagtgccacaaggagatgataacgaagcaggagcaggcccagctggctgcctcctccatcgatagcattgtcaatggcggtgacggcgggaaaggacctgtaattgctgcatctgtaaatgcggcagttcctcaagttgagcagaagactattgttgtgcagcccatgcttgtagctgaaaccagcgaggctgctgctgtaatccccaaggccaaggaaggcccagaccggtgcgcggcctgcaggaagcgtgttgggctgacgggatttagctgccgatgcgggaacatgtactgttcggtgcaccgctactccgacaaacatgactgtcagttcgactatcggactgcagcaagggacgcgattgccaaggccaatcctgtggtgagggcggagaagctcgacaagatctgaggcgggcattgggggagcgaaatggttgcaatctgcaagaattcaacatgctgtctttgctgcgttatcattgaaacttgccattcttgtctgctgctgcgtcccgtgaggttcaatactgtgatgcacacagcatccaggcagccgcaagaatttcatcaaaatggtttcccgtgttggctatgtcgtgtaagcttaattcagttattcatggtggtttcggtcggtattgtggtattcccatttaggtagctctgtaatgtattgctgtctcaagcgtgttacattccaattagtaatagtaatcagcaattgtctgccccatatattttttaaaaagtatgttcttgtgatgtcccagc

SEQ ID NO: 610 - protein, 171 aa, Zea mays
  misc_feature (1)..(171): Ceres Clone ID no. 1554153
  misc_feature (112)..(151): Pfam Name: zf-AN1 Pfam Description: AN1-like Zinc finger
  misc_feature (14)..(38): Pfam Name: zf-A20 Pfam Description: A20-like zinc finger
  misc_feature (1)..(171): Bit score of 327.9 for HMM based on sequences of Figure 3
  misc_feature (1)..(171): Functional Homolog Of SEQ ID NO. 451
MEHKEAGCQQPEGPILCINNCGFFGSAATMNMCSKCHKEMITKQEQAQLAASSIDSIVNGGDGGKGPVIAASVNAAVPQVEQKTIVVQPMLVAETSEAAAVIPKAKEGPDRCAACRKRVGLTGFSCRCGNMYCSVHRYSDKHDCQFDYRTAARDAIAKANPVVRAEKLDKI

SEQ ID NO: 611 - DNA, 808 bp, Brassica napus
  misc_feature (1)..(808): Ceres Clone ID no. 1362320
  misc_feature (1)..(808): Encodes the peptide sequence at SEQ ID NO. 612
tttatttcttcttcgaaagatcagaaatatattttattttgtgaaatttcgttgaagaagctttgaaattagaggaagaaatttcatttgatctgcacgtttctgatttgagaagaagaagaaaggaacaacaatgagctctgagcaaaacaacagcacaagcttcccaccaactgagccaaaactctgcgacaacggatgcggtttcttcgggtcaccttccaacatgaacctctgttccaaatgctacagaagtctccgagccgaggaagatcaaaccgccgtagcaaaagctgctgtcaagaactcacttaagcttccatcttgcagtctcattatcacaccagagcaaaaacagcctcttgaaaccaaaccagcctctgttgttgtaaccgctgagccgtcttcagttcctatagccacgggacaggaggaggcagagccgtcgaaacctgcgcggacgaacaggtgtttaagctgtaataagaaggttggagttatggggtttaagtgcaaatgcggtagcacgttttgcgggagccataggtacccggagaagcacgagtgtagcttcgatttcaaagaagttggacgtgatgcaatctcaaaggccaatcctgtgatcaaggcggacaaagtcgaaaggatatgaaaaatatcaaaccttttcttcttataaagtaatttggggtttctattttctctgcatttgatcaacttcttctttggatgtcgatgtgatgtgatcatgttggatgttgggtttctatgaatcaaaatgaaaattgctcctcttggttttatcatg

SEQ ID NO: 612 - protein, 172 aa, Brassica napus
  misc_feature (1)..(172): Ceres Clone ID no. 1362320
  misc_feature (113)..(151): Pfam Name: zf-AN1 Pfam Description: AN1-like Zinc finger
  misc_feature (17)..(40): Pfam Name: zf-A20 Pfam Description: A20-like zinc finger
  misc_feature (1)..(172): Bit score of 211.3 for HMM based on sequences of Figure 3
  misc_feature (1)..(172): Functional Homolog Of SEQ ID NO. 451
MSSEQNNSTSFPPTEPKLCDNGCGFFGSPSNMNLCSKCYRSLRAEEDQTAVAKAAVKNSLKLPSCSLIITPEQKQPLETKPASVVVTAEPSSVPIATGQEEAEPSKPARTNRCLSCNKKVGVMGFKCKCGSTFCGSHRYPEKHECSFDFKEVGRDAISKANPVIKADKVERI

SEQ ID NO: 613 - DNA, 598 bp, Zea mays
  misc_feature (1)..(598): Ceres Clone ID no. 1545291
  misc_feature (1)..(598): Encodes the peptide sequence at SEQ ID NO. 614
gacgacgcccccatttcgaagctcctcctcgcgattccaatccacgcacgccatctccgactccgcgtccgcctcgcgcaggacatatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgcctcctccatcgatagcattgtcaatggcggtgataatgggaaaggacctgcaattgctgcaactgtaggtgtggcagttcctcaagtcgaggagaagactatcgccgtgcagcctatgcatgtcgctgaaaccagcgaggctgctgctgttatcgcgaaggccaaggaaggcccaaaccggtgcgcaacctgtaggaagcgtgttgggttgacgggttttaactgccgatgcgggaacacgtactgttcgatgcaccgctactccgacaaacacgactgccagttcgactatcgaactgcagctagggacgctatcgccaaggccaatccagtggtgaaagcggagaagc

SEQ ID NO: 614 - protein, 167 aa, Zea mays
  misc_feature (1)..(167): Ceres Clone ID no. 1545291
  misc_feature (112)..(151): Pfam Name: zf-AN1 Pfam Description: AN1-like Zinc finger
  misc_feature (14)..(38): Pfam Name: zf-A20 Pfam Description: A20-like zinc finger
  misc_feature (1)..(167): Bit score of 319.4 for HMM based on sequences of Figure 3
  misc_feature (1)..(167): Functional Homolog Of SEQ ID NO. 451
MEHKEAGCQQPEGPILCINNCGFFGSAATMNMCSKCHKEMIMKQEQAQLAASSIDSIVNGGDNGKGPAIAATVGVAVPQVEEKTIAVQPMHVAETSEAAAVIAKAKEGPNRCATCRKRVGLTGFNCRCGNTYCSMHRYSDKHDCQFDYRTAARDAIAKANPVVKAEK

SEQ ID NO: 615 - DNA, 760 bp, Zea mays
  misc_feature (1)..(760): Ceres Clone ID no. 1589047
  misc_feature (1)..(760): Encodes the peptide sequence at SEQ ID NO. 616
gttgcccccacccagaccaaacccaggcttcccgttccctcgcttttgtccggcggccatggcggaggagcagcagcatcagagatggcaggagggccaccgcctgtgcgccaacaattgcggcttcttcggcagccccgcgacgctggacctctgctccaagtgctaccgcgacctataccagcagcagccagcaggcgcggcggcgggcccctccgctcccaccgcgtcggccttccagcattcctcctcggcagtctccggcgcggcggcggtctctcccgatctcgaacctcccgcgacggcccctgctggcgccaaggcgggcaggtgctccagctgccggaagcgcgtgggcctgacggggttcgcgtgccgctgcggagctaccttctgcggcgtgcaccgctacccggagcggcacgcgtgcgccttcgatttccgggccgccggccgcgacgccatcgcgcgcgccaaccccgtcgtcaagggcgataagctcaaggacaagatctgaggagcaggaaccgccgcctctcgcttcagagttcatgtcttccccccgtcagcggaactccggaagagcaaggacgaccgacggccagaagggacggatcgtcggattgtacgaattactcccgtgtactctacgattggtataaaacccaagcccgtcggttcgattgtgtaaagctggcggtgaaatcgctggccgtttactgaatgaaaaaaaattcaaatagaaaaatatttacttttc

SEQ ID NO: 616 - protein, 152 aa, Zea mays
  misc_feature (1)..(152): Ceres Clone ID no. 1589047
  misc_feature (92)..(130): Pfam Name: zf-AN1 Pfam Description: AN1-like Zinc finger
  misc_feature (15)..(38): Pfam Name: zf-A20 Pfam Description: A20-like zinc finger
  misc_feature (1)..(152): Bit score of 283.1 for HMM based on sequences of Figure 3
  misc_feature (1)..(152): Functional Homolog Of SEQ ID NO. 451
MAEEQQHQRWQEGHRLCANNCGFFGSPATLDLCSKCYRDLYQQQPAGAAAGPSAPTASAFQHSSSAVSGAAAVSPDLEPPATAPAGAKAGRCSSCRKRVGLTGFACRCGATFCGVHRYPERHACAFDFRAAGRDAIARANPVVKGDKLKDKI

SEQ ID NO: 617 - DNA, 749 bp, Zea mays
  misc_feature (1)..(749): Ceres P ID no. 101142707
  misc_feature (1)..(749): Encodes the peptide sequence at SEQ ID NO. 618
  misc_feature (518)..(518): n is a, c, t, g, unknown, or other
  misc_feature (599)..(599): n is a, c, t, g, unknown, or other
tttttaatcccttccgccctctccgctccccgttgcccccacccagaccaaacccaggcttcccgttccctcgcttttgtccggcggccatggcggaggagcagcagcatcagagatggcaggagggccaccgcctgtgcgccaacaattgcggcttcttcggcagccccgcgacgctggacctctgctccaagtgctaccgcgacctataccagcagcagccagcaggcgcggcggcgggcccctccgctcccaccgcgtcggccttccagcattcctcctcggcagtctccggcgcggcggcggtctctcccgatctcgaacctcccgcgacggcccctgctggcgccaaggcgggcaggtgctccagctgccggaagcgcgtgggcctgacggggttcgcgtgccgctgcggagctaccttctgcggcgtgcaccgctacccggagcggcacgcgtgcgccttcgatttccgggccgccggccgcgacgccctcgcgcgcgccaaccccgtcttnaagggcgataagcccaagggacaagatctgatgagcaagaaccgcccgcttttcgcttcaaagtccatggtttgccctcgnccccgggacccccggagagcaaagaccacccgagggcataaggacggtacctctggttgtcccaattacttcccgggtcacttcgaagggttaacaatcagtcccgcccgtttttttttttagcctgcgcgacaaccctttgcgcgtttt

SEQ ID NO: 618 - protein, 210 aa, Zea mays
  misc_feature (1)..(210): Ceres P ID no. 101142707
  misc_feature (92)..(130): Pfam Name: zf-AN1 Pfam Description: AN1-like Zinc finger
  misc_feature (15)..(38): Pfam Name: zf-A20 Pfam Description: A20-like zinc finger
  misc_feature (1)..(210): Bit score of 258.0 for HMM based on sequences of Figure 3
  misc_feature (1)..(210): Functional Homolog Of SEQ ID NO. 451
  misc_feature (143)..(143): Xaa is any aa, unknown or other
  misc_feature (170)..(170): Xaa is any aa, unknown or other
MAEEQQHQRWQEGHRLCANNCGFFGSPATLDLCSKCYRDLYQQQPAGAAAGPSAPTASAFQHSSSAVSGAAAVSPDLEPPATAPAGAKAGRCSSCRKRVGLTGFACRCGATFCGVHRYPERHACAFDFRAAGRDALARANPVXKGDKPKGQDLMSKNRPLFASKSMVCPXPRDPRRAKTTRGHKDGTSGCPNYFPGHFEGLTISPARFFF

SEQ ID NO: 619 - DNA, 588 bp, Triticum aestivum
  misc_feature (1)..(588): Ceres Clone ID no. 1433926
  misc_feature (1)..(588): Encodes the peptide sequence at SEQ ID NO. 620
tttcgaagcccaccgaattcctcgcgattcctctcccctcgcctcctcgtcctccccctcctaggggatcgccggagaggaatcgcgacgagggcttcctcctatcagttaaatcaaagtcatggagcacaaggagaccggctgccagtctcgtgagggccccatcctttgcgtcaataactgcggcttcttcggcagtgcggcgaccatgaacatgtgctccaagtgccacaaggagatggcgatgaagcaggagcaggccaagctggccgcctcctcttttgacagcatcgtcaacggtggtgatgccgcgaaagaacatcttgctgctggcaacacggcggtggcagttgctcacgtagaggcgaagatgcttattaccgcacagcctgctgatatcgccggtcccagtgaggcggcgatggagaaccccaaaggcccaagccggtgcagcacctgcagaaagagggtcgggctgaccggattcaactgccggtgcgggaacctctactgcgcgactcaccgttactcggacaagcatgagtgcaagtttgactaccgcgccgcggccatggacgccatcgccaa

SEQ ID NO: 620 - protein, 155 aa, Triticum aestivum
  misc_feature (1)..(155): Ceres Clone ID no. 1433926
  misc_feature (14)..(38): Pfam Name: zf-A20 Pfam Description: A20-like zinc finger
  misc_feature (110)..(148): Pfam Name: zf-AN1 Pfam Description: AN1-like Zinc finger
  misc_feature (1)..(155): Bit score of 241.9 for HMM based on sequences of Figure 3
  misc_feature (1)..(155): Functional Homolog Of SEQ ID NO. 451
MEHKETGCQSREGPILCVNNCGFFGSAATMNMCSKCHKEMAMKQEQAKLAASSFDSIVNGGDAAKEHLAAGNTAVAVAHVEAKMLITAQPADIAGPSEAAMENPKGPSRCSTCRKRVGLTGFNCRCGNLYCATHRYSDKHECKFDYRAAAMDAIA

SEQ ID NO: 621 - DNA, 751 bp, Musa acuminata
  misc_feature (1)..(751): Ceres Clone ID no. 1734621
  misc_feature (1)..(751): Encodes the peptide sequence at SEQ ID NO. 622
gtgcgcccacctctttccttcaccaccctctctctcctcgcctctatctctctcctgctcctcccctatattacgatccagcctggtatcgacgctcttcccgtcccgtggagcaaagccggaaccatctgtaccctttgtctttctattgtctcaccgtcattgattcgattcggaggcaccggtcgtaacggatttgactttgttcttgttgttcttccccaaagatcgaccgagaagacaagaggatggcggaggagcagcgatgccaggagggccaccgcctctgcgctaacaactgtggattcctcgggagccctgcgacgctcaacctctgccccaaatgctaccgcgaccaccgccttaaggaggagcagcagcggcaggacgcctcgcacgcggccaacgtagccgccgccgagaaacccccccacgcgtcctcctcggcctcggtcgtggcgtccccggccgggaacgcgagagggcccccggcgctggcctctccggcggtcgcggcggcggcggcgggaccgagccggtgcgcgatgtgccggaagagggtgggcctgacggggttccggtgccggtgcggggccacccactgcggggcacaccggcacgcggagcagcacagctgcaccttcgacttcaaggcggccggccgggaggccatcacccgcgccaaccccgtcgtcaaggccgacaagctcaacaggatctgaagaatccccaccctccgtttctccctgct

SEQ ID NO: 622 - protein, 157 aa, Musa acuminata
  misc_feature (1)..(157): Ceres Clone ID no. 1734621
  misc_feature (98)..(136): Pfam Name: zf-AN1 Pfam Description: AN1-like Zinc finger
  misc_feature (12)..(35): Pfam Name: zf-A20 Pfam Description: A20-like zinc finger
  misc_feature (1)..(157): Bit score of 296.0 for HMM based on sequences of Figure 3
  misc_feature (1)..(157): Functional Homolog Of SEQ ID NO. 451
MAEEQRCQEGHRLCANNCGFLGSPATLNLCPKCYRDHRLKEEQQRQDASHAANVAAAEKPPHASSSASVVASPAGNARGPPALASPAVAAAAAGPSRCAMCRKRVGLTGFRCRCGATHCGAHRHAEQHSCTFDFKAAGREAITRANPVVKADKLNRI

SEQ ID NO: 623 - DNA, 730 bp, Musa acuminata
  misc_feature (1)..(730): Ceres Clone ID no. 1731531
  misc_feature (1)..(730): Encodes the peptide sequence at SEQ ID NO. 624
attctggtctctctcaccttaactctccttttggagccctcgattccacgattccgaggcgatttccggccgctgaagggatcgtcgagcgttttgattggcggagatcgccgcaggcgaatcgcaaagagggctgatcccaaaaggagagtttgcaatggagcacgatgagaccggatgccaagcacgtgaaggaccaatcctttgcatcaacaactgtggattcttcggaagtgccgcaaccatgaacttgtgctccaagtgccacaaggacatgattctcaagcaggaacaggccaagatggcggcatcctcgatcgacagcctcgtgaatggcaatggcaatggcagtggcagtggaaaagagcccgtcgtttcgggtaatgctgttgttgctgttggctccatggagccgaaagtgatttcagcacagtcatccgatgctttagcctcaaacgaggccggagaggcaaaggcgaaggagggtccaaacaggtgtggcacctgcaggaaacgcgttggtctgactggtttcagttgtcggtgtgggaaccttttctgtgctgtgcaccgctactcggataagcacgactgccaattcgactaccgaaaggcggcccaggatgcaattgccaaagcaaaccctgtcattaaggccgaaaagcttgataagatctagagatatgggttaaaggttaatgaactctgttccgatgatctccacgttatc

SEQ ID NO: 624 - protein, 173 aa, Musa acuminata
  misc_feature (1)..(173): Ceres Clone ID no. 1731531
  misc_feature (14)..(38): Pfam Name: zf-A20 Pfam Description: A20-like zinc finger
  misc_feature (114)..(153): Pfam Name: zf-AN1 Pfam Description: AN1-like Zinc finger
  misc_feature (1)..(173): Bit score of 327.5 for HMM based on sequences of Figure 3
  misc_feature (1)..(173): Functional Homolog Of SEQ ID NO. 451
MEHDETGCQAREGPILCINNCGFFGSAATMNLCSKCHKDMILKQEQAKMAASSIDSLVNGNGNGSGSGKEPVVSGNAVVAVGSMEPKVISAQSSDALASNEAGEAKAKEGPNRCGTCRKRVGLTGFSCRCGNLFCAVHRYSDKHDCQFDYRKAAQDAIAKANPVIKAEKLDKI

SEQ ID NO: 625 - protein, 173 aa, Prunus armeniaca
  misc_feature (1)..(173): Public GI ID no. 5031281
  misc_feature (15)..(39): Pfam Name: zf-A20 Pfam Description: A20-like zinc finger
  misc_feature (114)..(153): Pfam Name: zf-AN1 Pfam Description: AN1-like Zinc finger
  misc_feature (1)..(173): Bit score of 278.4 for HMM based on sequences of Figure 3
  misc_feature (1)..(173): Functional Homolog Of SEQ ID NO. 451
MEHEETGCQPHPEGPILCVNNCGFFGSVATRNMCSKCHKDMMLKEEQAKLAASSFGNIVNGTSNSNGNEPVVAAGVDVQAHLVEPKTISLQPSFSFGSGSGGSGEAKPEGPKRCGTCNKRVGLTGFNCRCGHLFCAVHRYSDKHDCPYDYHTAARDVIAKANPVVKADKLEKI

SEQ ID NO: 626 - DNA, 696 bp, Panicum virgatum
  misc_feature (1)..(696): Ceres Clone ID no. 1911017
  misc_feature (1)..(696): Encodes the peptide sequence at SEQ ID NO. 627
ctctctcgacgctcgacccggaaaaaaaaattattctccgcgggggggaaggggaaaggtcgcgtggcgtctcggtctcgcccacagtccatcggtagcaatggcacaagagagctggaaacaagagaccgaggcgactggagtccacgcgcctgaggcccctattctctgcataaacaactgtggtttctttggcagcagcatgacgaacaatatgtgctcgaagtgctacagggacttcgtcaagttgatggaagcccctgtagtggagaagaaggtgatcacgtcagcatcttcttccgcggcaccactggagacaatgcgagatgatgtgcctacagctgctgccactgaagctgtgactgagaagcaagcagagcaagagcccccaaagccgcccagcaaccggtgcctgacctgccgcaagaaggtcggactgaccggcttcctttgccgctgtgggggcaccttctgctccacgcaccgctacaccgactcccaccagtgcacctttgactacaagaaggtggcacgggagcagatagccaagcagaatccagttgtgatggccgagaagataaacaagatctgatgcatgcccgtgaagggatcgctgagttcatgcctgggtttcgagtcctcaagttcactacaatcgataggttccttcgggtggtggtctgggttagcgtggta

SEQ ID NO: 627 - protein, 163 aa, Panicum virgatum
  misc_feature (1)..(163): Ceres Clone ID no. 1911017
  misc_feature (21)..(45): Pfam Name: zf-A20 Pfam Description: A20-like zinc finger
  misc_feature (104)..(142): Pfam Name: zf-AN1 Pfam Description: AN1-like Zinc finger
  misc_feature (1)..(163): Bit score of 363.2 for HMM based on sequences of Figure 3
  misc_feature (1)..(163): Functional Homolog Of SEQ ID NO. 451
MAQESWKQETEATGVHAPEAPILCINNCGFFGSSMTNNMCSKCYRDFVKLMEAPVVEKKVITSASSSAAPLETMRDDVPTAAATEAVTEKQAEQEPPKPPSNRCLTCRKKVGLTGFLCRCGGTFCSTHRYTDSHQCTFDYKKVAREQIAKQNPVVMAEKINKI

SEQ ID NO: 628 - DNA, 1679 bp, Panicum virgatum
  misc_feature (1)..(1679): Ceres Clone ID no. 1955228
  misc_feature (1)..(1679): Encodes the peptide sequence at SEQ ID NO. 629
gaggctcctccttgcgattccaatccccgcccgcctcctccgcctccgcgtccgcctcgcgcagggtttgggtttgctctgctcccccatctcgtgctttacctttcttttttcatgtgcgatttgtttgggaaggcttgatctgtgtcattcggggcctgattcgacgtcccttgatcgatctgcgcggttgacttgtgatgttttttgggtgttgattcgttggtgcgggcgattccacgggccgtggaatcgccaaggggacgggcgcttccagggttcgggggttgatttggtctaaggttggttgtttcttctgttcaggtggaagtcctttggggtgggggaaaatggaaacgcgttctttttttcttgttatttttttttaaaatttgtatttaaggctgtatctcctggcgaaatgattagccttacctgtatttttttggtctgatttcttaaagttcgtggggctgttaaatgttactagtgatttaagtattttgttccgtggaaatcgcgtgtatttagttgttttagatgtggattagttaaattactttgtagatttggtgcatgttgttctcgatttacatcctcatggattttttttttactttttccaaagatttgaattgatataccctgatttgtttaggaatgttgggttgatttgtattgcgcaggatactttgagatagtgacttctgcgatgcaatccctgcaaattaggatcttgtttcatcgagtgcaatccctgcatgactgatgttttctgaagttacaaaccttgtggtgatttacattgattgtttaaatgcagcttatagtagtcatggaacacaaggagacgggctgccagcaaccggagggcccaatactatgcatcaacaactgtggcttctttggcagtgcggccaccatgaacatgtgctccaagtgccacaaggagatgataatgaagcaggagcattcccagctggctgcctcctccattgatagcattgtcaatggcggtgatggtgggaaaggccctatcatagctgcaaccgcagaggtggcggttgctcaagttgaggagaggactattgttgtgcagcctccatttgtagctgaaaccagcgaggctgctgccattatccccaaggccaaggaaggtccgaaccggtgcgcaacctgtaggaagcgggttggtctgacgggattcaactgccgatgcggtaacatgtactgtgcgttgcaccgctactccgacaaacatgactgccagtttgactaccagactgcagctagggatgcgattgccaaggccaatcctgtggtgaaggcggagaagcttgaaaagatctgaagggggcaatggggaacgaaatgggttgcgttctgcaagattcaatcatgcatctttgctgctttatcattgaacatcccattcttgtttgctgccacatccctgagtcgttcaacactatgatgctcacgcatcctggcagctgcaagaagtcatcctcagtcgagtccaaaatggtttgcgtgttggctatgttgtgtaagcttattcagttattcatggtggtttcagtcggtattgtggcatttccatttaggtagctctgtaatgtactactgtctcatgcgtgttacattccaatcagtaatagtaatcagcaatggtctgc

SEQ ID NO: 629 - protein, 177 aa, Panicum virgatum
  misc_feature (1)..(177): Ceres Clone ID no. 1955228
  misc_feature (118)..(157): Pfam Name: zf-AN1 Pfam Description: AN1-like Zinc finger
  misc_feature (20)..(44): Pfam Name: zf-A20 Pfam Description: A20-like zinc finger
  misc_feature (1)..(177): Bit score of 343.8 for HMM based on sequences of Figure 3
  misc_feature (1)..(177): Functional Homolog Of SEQ ID NO. 451
MQLIVVMEHKETGCQQPEGPILCINNCGFFGSAATMNMCSKCHKEMIMKQEHSQLAASSIDSIVNGGDGGKGPIIAATAEVAVAQVEERTIVVQPPFVAETSEAAAIIPKAKEGPNRCATCRKRVGLTGFNCRCGNMYCALHRYSDKHDCQFDYQTAARDAIAKANPVVKAEKLEKI

SEQ ID NO: 630 - DNA, 680 bp, Panicum virgatum
  misc_feature (1)..(680): Ceres Clone ID no. 1867313
  misc_feature (1)..(680): Encodes the peptide sequence at SEQ ID NO. 631
gcctggcccgacgacgcccccatttcgaggctcctccttgcgattccaatccccgcacgcctcctccgcctccgcgtccgcctcgcgcaggttatagtagtcatggaacacaaggagacgggctgccagcaaccggaggggccaatactatgcatcaacaactgtggcttctttggcagtgcggccaccatgaacatgtgctccaagtgccacaaggagatgataatgaagcaggagcaggcccagctggctgcctcctccattgatagcattgtcaatggcggtgacggtgggaaaggccttattatagctgcaaccgcagaggtggcggttgctcaagttgaggagaagactattgttgtgcagcctccatttgtagctgaaaccagcgaggctgctgttgttgtacccaaggccaaagaaggtccgaaccggtgtgcaagctgtaggaagcgggttggcctgacgggtttcaactgccgatgcggtaacatgtactgcgcgatgcaccgctactccgacaaacatgactgccagtttgactaccagactgcagctagggatgcgattgccaaggccaatcctgtggtgaaggcggagaagctcgacaagatctgaagggggcaatggggaacgaaatgggttgcgatctgcaagattcaagcatgcatctttgctgc

SEQ ID NO: 631 - protein, 171 aa, Panicum virgatum
  misc_feature (1)..(171): Ceres Clone ID no. 1867313
  misc_feature (112)..(151): Pfam Name: zf-AN1 Pfam Description: AN1-like Zinc finger
  misc_feature (14)..(38): Pfam Name: zf-A20 Pfam Description: A20-like zinc finger
  misc_feature (1)..(171): Bit score of 348.4 for HMM based on sequences of Figure 3
  misc_feature (1)..(171): Functional Homolog Of SEQ ID NO. 451
MEHKETGCQQPEGPILCINNCGFFGSAATMNMCSKCHKEMIMKQEQAQLAASSIDSIVNGGDGGKGLIIAATAEVAVAQVEEKTIVVQPPFVAETSEAAVVVPKAKEGPNRCASCRKRVGLTGFNCRCGNMYCAMHRYSDKHDCQFDYQTAARDAIAKANPVVKAEKLDKI

SEQ ID NO: 632 - DNA, 937 bp, Panicum virgatum
  misc_feature (1)..(937): Ceres Clone ID no. 1955668
  misc_feature (1)..(937): Encodes the peptide sequence at SEQ ID NO. 633
acgacgacgcccccatttcgaggctcctccttgcgattccaatccccgcacgcatcttccgcctcgcgcaggctatagtagtcatggaacacaaggaggcgggctgccagcaaccggaggggccaatactatgcatcaacaactgtggcttctttggcagtgcggccaccatgaacatgtgctccaagtgccacaaggagatgataatgaagcaggagcaggcccagctggctgcctcctccattgatagcattgtcaatggcggtgacggtgggaaaggccttattatagctgcaaccgcagaggtggcggttgctcaagttgaggagaagactattgttgtgcagcctccatttgtagctgaaaccagcgaggctgctgtcgttatacccaaggccaaagaaggtccgaaccggtgtgcaagctgtaggaagcgggttggcctgacgggtttcaactgccgatgcggtaacatgtactgcgcgatgcaccgctactccgacaaacatgactgccagtttgactaccagactgcagctagggatgcgattgccaaggccaatcctgtggtgaaggcggagaagctcgacaagatctgaagggggcaatggggaacgaaatgggttgcgatctgcaagattcaatcatgcatctttgctgctttatcattgaacatcccattcttgtttgctgccacatccctgagttgttcaacactatgatgctcacgcatcctggcagctgcaagaactcatcctcagtcgagttcaaaatggtttgcgtgttggctatgttgtgtaagcttattcagttattcatggtggtttcagtggtttcagtcggtattgtggcattcccatttaggtagctctgtaatgtactattgtctcatgcgtgctacattccaatcagtaatagtaatcagcaatggtctgcc

SEQ ID NO: 633 - protein, 171 aa, Panicum virgatum
  misc_feature (1)..(171): Ceres Clone ID no. 1955668
  misc_feature (112)..(151): Pfam Name: zf-AN1 Pfam Description: AN1-like Zinc finger
  misc_feature (14)..(38): Pfam Name: zf-A20 Pfam Description: A20-like zinc finger
  misc_feature (1)..(171): Bit score of 343.7 for HMM based on sequences of Figure 3
  misc_feature (1)..(171): Functional Homolog Of SEQ ID NO. 451
MEHKEAGCQQPEGPILCINNCGFFGSAATMNMCSKCHKEMIMKQEQAQLAASSIDSIVNGGDGGKGLIIAATAEVAVAQVEEKTIVVQPPFVAETSEAAVVIPKAKEGPNRCASCRKRVGLTGFNCRCGNMYCAMHRYSDKHDCQFDYQTAARDAIAKANPVVKAEKLDKI

SEQ ID NO: 634 - DNA, 750 bp, Panicum virgatum
  misc_feature (1)..(750): Ceres Clone ID no. 1765871
  misc_feature (1)..(750): Encodes the peptide sequence at SEQ ID NO. 635
gttggctaacaatcccattgctgcgctgcagcccatctgtagcaatggcacaggagagctggaaacaggagtccgaggagactggagtccatgcgcctgaggccccaattctgtgcataaacaactgtgttttcttcggcagcagcatgacaaacaatatgtgctcgaagtgctacagggacttcatcaagttgatggaagcccctgtggttgagaagaaggtgatcacggtggcatcttcttctgcggcaccaatggagacagcaaatcaagatgatgtgcctgcagctgctgccgctgaagctgttgcggagaagcaagcagagcaggagccgccaaagccgcccagcaaccggtgcctgacctgccgcaagaaggttgggctgaccggctttctctgccgctgtgggggcaccttctgctccatgcaccgctacaccgactcccaccagtgcacctttgactacaagaaggtggcacgggagcagattgccaagcaaaatccagttgtgatggcagagaagatcaacaagatatgatgcatggtcgtgtgcagggattgctgaattcatgcctgagttcctgagtcctcaagttcactccaaacgataggttccttcaggtggtggtctgggttagcgtggtagggggtctcaattgtgtctatccttctcctttatcatggtttcattctctcgattgtgtaataatgtaaatatattcaaactgtaatttaatcatattgcttcc

SEQ ID NO: 635 - protein, 164 aa, Panicum virgatum
  misc_feature (1)..(164): Ceres Clone ID no. 1765871
  misc_feature (105)..(143): Pfam Name: zf-AN1 Pfam Description: AN1-like Zinc finger
  misc_feature (21)..(45): Pfam Name: zf-A20 Pfam Description: A20-like zinc finger
  misc_feature (1)..(164): Bit score of 348.0 for HMM based on sequences of Figure 3
  misc_feature (1)..(164): Functional Homolog Of SEQ ID NO. 451
MAQESWKQESEETGVHAPEAPILCINNCVFFGSSMTNNMCSKCYRDFIKLMEAPVVEKKVITVASSSAAPMETANQDDVPAAAAAEAVAEKQAEQEPPKPPSNRCLTCRKKVGLTGFLCRCGGTFCSMHRYTDSHQCTFDYKKVAREQIAKQNPVVMAEKINKI

SEQ ID NO: 636 - DNA, 727 bp, Panicum virgatum
  misc_feature (1)..(727): Ceres Clone ID no. 1870976
  misc_feature (1)..(727): Encodes the peptide sequence at SEQ ID NO. 637
cccggacccccacggccaccccagcccagcctgccctgcgccgcgccgcgctgtccctgacccggcggccatggcggaggagcagcagcggcagaggtggcaggagggccaccgcctgtgcgccaacaactgcggcttcttcggcagccccgccacgctggacctctgctccaagtgctaccgcgacctcaaccagaaccagcccgcccccgtgccaccgccgccggcctgcacgccgccatccgcctccgtctcagctcccgaggcgggcgccgccgcggcctcttctgcgcccgggcctccgtcgacgccccctgcgcaggccggcaggtgcgagagctgccggaagcgcgtgggcctgacggggttcgcgtgccgctgcggcgccaccttctgcggcgtgcaccggtacccggagcgccacgcgtgcgccttcgacttcggcgccgccggccgcgacgccatcgcgcgcgccaaccccatcgtcaggggcgacaagctcaaggacaaggtctgaggatcccgacgcggcgccggagggaggaggaggacggcgacccgaacgaatcgtcggactgctccgtaaagcacttccgtgtaccctgcaattggtgtagcctcctcagctgcatgtgtaacccgacgcaccgtaaagctgaaatcgaaagctaaactgatttcgaaatagagacccggatcggcggccttgctgcgttcagttgttgtg

SEQ ID NO: 637 - protein, 148 aa, Panicum virgatum
  misc_feature (1)..(148): Ceres Clone ID no. 1870976
  misc_feature (88)..(124): Pfam Name: zf-AN1 Pfam Description: AN1-like Zinc finger
  misc_feature (15)..(38): Pfam Name: zf-A20 Pfam Description: A20-like zinc finger
  misc_feature (1)..(148): Bit score of 254.8 for HMM based on sequences of Figure 3
  misc_feature (1)..(148): Functional Homolog Of SEQ ID NO. 451
MAEEQQRQRWQEGHRLCANNCGFFGSPATLDLCSKCYRDLNQNQPAPVPPPPACTPPSASVSAPEAGAAAASSAPGPPSTPPAQAGRCESCRKRVGLTGFACRCGATFCGVHRYPERHACAFDFGAAGRDAIARANPIVRGDKLKDKV

SEQ ID NO: 638 - DNA, 1029 bp, Panicum virgatum
  misc_feature (1)..(1029): Ceres Clone ID no. 1990071
  misc_feature (1)..(1029): Encodes the peptide sequence at SEQ ID NO. 639
  misc_feature (601)..(601): r is g or a
gccttcgcctacctctcgacgcccaaccccaaaaagaaaaattctcctcgcggagaaaggtcgcgtgccgtctcgcccacaggttggcggcgggcttcgcgtcgaggcgcggccggttggttctggatcggatctgcgcggattggaattgggttgacccggtgggtttggtggcacagggtctgcgcgcctctgttacggaggatttgggctcgcctgtgggtattttccctttaattatttgcagatcatttgcggtggtttgttttctaggctggcactggcaggcgagacctcaacctttgtgaacagcggagggggtgaatcagtgaaggatagcgagtccgtccgcgtggttgatgaacaaactttggtggttgccggcggatgtgggagtgggttcatcctggcgccgccgggtgcacgccgcggcgtgcgtggctgcttgcttgtcgcagggctcttccatccctgcgtcacatgcgagcttcgtgccaattcgtgaagcaggcgagagatgtttgctgataaggtctcctgtggcccttgtgtagggggtggatgaagcggcgagcttcctttccgtgctcggcgtgggtarccttgattgtggccagaggtttcgtgctggccatggcaaggtctattgcttggacgtgtggataaaggtttgactgcctgaattggctgtgtgcatctacctgattgcagttccgggcactgattgcttcgcctgtatgctgctggttgcctgccttgtgctgctactacatatgcaatctgtggagcaaccaaaaagaccttggcttcatgctatgattgtgtcaagcaattgactaaccacgcccatctgttgcaatggcacacgagagctggaaacaggaatctgaggagactggagtccatgcacctgaggccccaattctgtgcataaacaactgtggtttcttcggcagcagcatgacgaacaatatgtgctcgaagtgctccagggacttcatcaaattgttggaaggccctgtggtagag

SEQ ID NO: 639 - protein, 164 aa, Panicum virgatum
  misc_feature (1)..(164): Ceres Clone ID no. 1990071
  misc_feature (105)..(143): Pfam Name: zf-AN1 Pfam Description: AN1-like Zinc finger
  misc_feature (21)..(43): Pfam Name: zf-A20 Pfam Description: A20-like zinc finger
  misc_feature (1)..(164): Bit score of 326.2 for HMM based on sequences of Figure 3
  misc_feature (1)..(164): Functional Homolog Of SEQ ID NO. 451
  misc_feature (30)..(30): Xaa is any aa, unknown or other
  misc_feature (44)..(44): Xaa is any aa, unknown or other
  misc_feature (51)..(51): Xaa is any aa, unknown or other
MAHESWKQESEETGVHAPEAPILCINNCGXFGSSMTNNMCSKCXRDFIKLXEGPVVEKKVITVASSSAAPMETAKQDDVPAAAATEAVTEKQAEQEPPKPPSNRCLTCRKKVGLTGFLCRCGGPFCSMHRYTDSHQCTFDYKKVAREQIAKQNPVVMAEKINKI

SEQ ID NO: 640 - DNA, 576 bp, Panicum virgatum
  misc_feature (1)..(576): Ceres Clone ID no. 1965620
  misc_feature (1)..(576): Encodes the peptide sequence at SEQ ID NO. 641
ccctggcccgacgacgcccccatttcgaggctcctccttgcgattccaatccccgcccgcctcctccgcgtccgcctcgcgcagggtttggcttatagtagtcatggaacacaaggagacgggctgccagcaaccggagggcccaatactatgcatcaacaactgtggcttctttggcagtgcggccaccatgaacatgtgctccaagtgccacaaggagatgataatgaagcaggagcattcccagctggctgcctcctccattgatagcattgtcaatggcggtgatggtgggaaaggccctatcatagctgcaaccgtagaggtggcggttgctcaagttgaggagaagactattgttgtgcagcctccatttgtagctgaaaccagcgaggctgctgccattatccccaaggccaaggaaggtccgaaccggtgcgcaacctgtaggaagcgggttggtctgacgggattcaactgccgatgcggtaacatgtactgtgcgttgcaccgctactccgacaaacatgactgccagtttgactaccagactgcagctagggatgcgattgccaa

SEQ ID NO: 641 - protein, 157 aa, Panicum virgatum
  misc_feature (1)..(157): Ceres Clone ID no. 1965620
  misc_feature (112)..(151): Pfam Name: zf-AN1 Pfam Description: AN1-like Zinc finger
  misc_feature (14)..(38): Pfam Name: zf-A20 Pfam Description: A20-like zinc finger
  misc_feature (1)..(157): Bit score of 273.5 for HMM based on sequences of Figure 3
  misc_feature (1)..(157): Functional Homolog Of SEQ ID NO. 451
MEHKETGCQQPEGPILCINNCGFFGSAATMNMCSKCHKEMIMKQEHSQLAASSIDSIVNGGDGGKGPIIAATVEVAVAQVEEKTIVVQPPFVAETSEAAAIIPKAKEGPNRCATCRKRVGLTGFNCRCGNMYCALHRYSDKHDCQFDYQTAARDAIA

SEQ ID NO: 642 - DNA, 688 bp, Panicum virgatum
  misc_feature (1)..(688): Ceres Clone ID no. 1995041
  misc_feature (1)..(688): Encodes the peptide sequence at SEQ ID NO. 643
aacccatttccttcctgcccgcaacccagcccaggcccggcggtccctcgatcctctcggctccggatcggcaagagcccagccgccgccgcccgtagccgcctcgctgccggattcacacgacacctcgtcggcgtctctttctctctctctcgaggcccatggcgcagcgcgacaagaaggtggaggagccgacggagctgcacgcgccggagctcacgctctgcgccaacagctgcggcttcccgggcaactcggccaccaagaacctctgccagaactgcttcctggccgcctccgcctccgcctccgcctccgtctcgccgccgtcgccctcctcctcctcgccggcggtgttcgacaagccgcggacggcggcggcggcggccgcccctcccgcgctctggccgccgttctccccggccgccaaccggcccccggcgggccccgcggagtccccctccaaggcgccccggacgtcgtcgtcgatcaaccggtgccacagctgccggaagcgggtcgggctgacggggttccggtgccgctgcggcgagctcttctgcggcgcgcaccggtactcggaccgccacgactgcggctacgactacaagggcgtcgcccgggacgccatcgcccgggagaaccccgtcgtgcgcgccgccaagatcgtcaggttctgagagagctg

SEQ ID NO: 643 - protein, 172 aa, Panicum virgatum
  misc_feature (1)..(172): Ceres Clone ID no. 1995041
  misc_feature (113)..(151): Pfam Name: zf-AN1 Pfam Description: AN1-like Zinc finger
  misc_feature (21)..(42): Pfam Name: zf-A20 Pfam Description: A20-like zinc finger
  misc_feature (1)..(172): Bit score of 188.4 for HMM based on sequences of Figure 3
  misc_feature (1)..(172): Functional Homolog Of SEQ ID NO. 451
MAQRDKKVEEPTELHAPELTLCANSCGFPGNSATKNLCQNCFLAASASASASVSPPSPSSSSPAVFDKPRTAAAAAAPPALWPPFSPAANRPPAGPAESPSKAPRTSSSINRCHSCRKRVGLTGFRCRCGELFCGAHRYSDRHDCGYDYKGVARDAIARENPVVRAAKIVRF

SEQ ID NO: 644 - DNA, 1111 bp, Panicum virgatum
  misc_feature (1)..(1111): Ceres Clone ID no. 2015820
  misc_feature (1)..(1111): Encodes the peptide sequence at SEQ ID NO. 645
cccccaacccatttccttcctgcccgcaacccagcccaggcccggcggtccctcgatcctctcggctccggatcggcaagagcccagccgcagccgcccgtagccgcctcgctgccggattcacacgacgccttgtcggcgtctctctctctctcgaggcccatggcgcagcgcgacaagaaggtggaggagccgacggagctgcacgcgccggagctcacgctctgcgccaacagctgcggcttcccgggcaacccggccaccaagaacctctgccagaactgcttcctggccgcctccgcctccgtctcgccgccgtcgccctcctcctcctcgccggcggtgttcgacaagccgcggacggcggcggcggcggccgcccctcccgcgctctggccgccgttctccccggccgccaaccggcccccggcgggccccgcggagtccccctccaaggcgccccggacgtcgtcgtcgatcaaccggtgccacagctgccggaagcgggtcgggctgacggggttccggtgccgctgcggcgagctcttctgcggcgcgcaccggtactcggaccgccacgactgcggctacgactacaagggcgtcgcccgggacgccatcgcccgggagaaccccgtcgtgcgcgccgccaagatcgtcaggttctgagagagctggggagcaccggaggaccacgcacagctcagctccacgccgatcgtcgatccatcatctcccgcgctccggaatcccctctcttttttctctttttctttcctcttttgttacaaaatttaaaggtgattggtcgagctgtcatcacgctgttctcgagaatcccacaaacaagaagaagatgatttgattgatgaaggaaaaagaagaaggagcagatcatgggaaccatgaaggcagggaagctgcgagaaaaaggggatcgagagcacagtgcgatgataatgttgttgttgtagcggtggttggggtggaggggaagagatagagtcggtttggtgtgttgtcctactacaaatcacaatcttctattaaatttttcttccatctctctgtataaactaaattataattgggatctccctattgcccagct

SEQ ID NO: 645 - protein, 168 aa, Panicum virgatum
  misc_feature (1)..(168): Ceres Clone ID no. 2015820
  misc_feature (109)..(147): Pfam Name: zf-AN1 Pfam Description: AN1-like Zinc finger
  misc_feature (21)..(42): Pfam Name: zf-A20 Pfam Description: A20-like zinc finger
  misc_feature (1)..(168): Bit score of 181.5 for HMM based on sequences of Figure 3
  misc_feature (1)..(168): Functional Homolog Of SEQ ID NO. 451
MAQRDKKVEEPTELHAPELTLCANSCGFPGNPATKNLCQNCFLAASASVSPPSPSSSSPAVFDKPRTAAAAAAPPALWPPFSPAANRPPAGPAESPSKAPRTSSSINRCHSCRKRVGLTGFRCRCGELFCGAHRYSDRHDCGYDYKGVARDAIARENPVVRAAKIVRF

SEQ ID NO: 646 - DNA, 1114 bp, Panicum virgatum
  misc_feature (1)..(1114): Ceres Clone ID no. 1724157
  misc_feature (1)..(1114): Encodes the peptide sequence at SEQ ID NO. 647
cccccaacccatttccttcctgcccgcaacccagcccaggcccggcggtccctcgatcctctcggctccggatcggcaagagcccagccgccgccgccgcccgtagccgcctcgctgccggattcacacgacacctcgtcggcgtctctttctctctctctctcgaggcccatggcgcagcgcgacaagaaggtggaggagccgacggagctgcacgcgccggagctcacgctctgcgccaacagctgcggcttcccgggcaacccggccaccaagaacctctgccagaactgcttcctggccgcctccgcctccgtctcgccgccgtcgccctcctcctcgccggcggtgttcgacaagtcgcggacggcggcggcggcggccgcccctcccgcgctctggccgccgttctccccggccgccaaccggcccccggcgggccccgcggagtccccctccaaggcgccccggacgtcgtcgtcgatcaaccggtgccacagctgccggaagcgggtcgggctgacggggttccggtgccgctgcggcgagctcttctgcggcgcgcaccggtactcggaccgccacgattgcggctacgactacaagggcgtcgcccgggacgccatcgcccgggagaaccccgtcgtgcgcgccgccaagatcgtcaggttctgagagagctggggagcaccggaggaccacgcacagctcagctccacgccgatcgtcgatccatcatctcccgcgctccggaatcccctctcttttttctctttttctttcctcttttgttacaaaatttaaaggtgattggtcgagggtgctgtcatcacgctgttctcgagaatcccacaaacaagaagaagatgatttgattgatgaaggacaaagaaggagcagatcatgggaaccatgaaggcagggaagctgcgagaaaaaggggatcgagagcacagagcgatgataatgttgttgttgtagcggtggttggggtggaggggaagagatagggtcggtttggtgtgttgtcctactacaaatcacaatcttctattaaatttttcttccatctctctgtataaactaaattataattggaatctccctattgccc

SEQ ID NO: 647 - protein, 167 aa, Panicum virgatum
  misc_feature (1)..(167): Ceres Clone ID no. 1724157
  misc_feature (108)..(146): Pfam Name: zf-AN1 Pfam Description: AN1-like Zinc finger
  misc_feature (21)..(42): Pfam Name: zf-A20 Pfam Description: A20-like zinc finger
  misc_feature (1)..(167): Bit score of 185.9 for HMM based on sequences of Figure 3
  misc_feature (1)..(167): Functional Homolog Of SEQ ID NO. 451
MAQRDKKVEEPTELHAPELTLCANSCGFPGNPATKNLCQNCFLAASASVSPPSPSSSPAVFDKSRTAAAAAAPPALWPPFSPAANRPPAGPAESPSKAPRTSSSINRCHSCRKRVGLTGFRCRCGELFCGAHRYSDRHDCGYDYKGVARDAIARENPVVRAAKIVRF

SEQ ID NO: 648 - DNA, 1114 bp, Panicum virgatum
  misc_feature (1)..(1114): Ceres Clone ID no. 1724165
  misc_feature (1)..(1114): Encodes the peptide sequence at SEQ ID NO. 649
caacccatttccttcctgcccgcaaggccgcaacccagcccaggcccggcggtccctcgatcctctcggctccggatcggcaagagcccagccgccgccgcccgtagccgcctcgctgccggattcacacgacaccttgtcggcgtctctttctctctctcgaggcccatggcgcagcgcgacaagaaggttgaggagccgacggagctgcacgcgccggagctcacgctctgcgccaacagctgcggcttcccgggcaacccggccaccaagaacctctgccagaactgcttcctggccgcctccgcctccgtctcgccgccgtcgccctcctcctcgccggcggtgttcgacaagccgcggacggcggcggcggcggccgcccctcccgcgctctggccgccgttctccccggccgccaaccggcccccagcgggccccgcggagtccccctccaaggcgccccggacgtcgtcgtcggtcaaccggtgccacagctgccggaagcgggtcgggctgacggggttccggtgccgctgcggcgagctcttctgcggcgcgcaccggtactcggaccgccacgactgcggctacgactacaagggcgtcgcccgggacgccatcgcccgggagaaccccgtcgtgcgcgccgccaagatcgtcaggttctgagagagctggggagcaccggaggaccacgcacagctcagctccacgccgatcgtcgatccatcatctcccgcgctccggaatcccctctcttttttctctttttctttcctcttttgttacaaaatttaaaggtgattggtcgagggtgctgtcatcacgctgttctcgagaatcccacaaacaagaagaagatgatttgattgatgaaggaaaaagaagaaggagcagatcatgggagccatgaaggcagggaagctgcgagaaaaaggggatcgagagcacagtgcgatgataatgttgttgttgtagcggtggttggggtggaggggaagagatagggtcggtttggtgtgttgtcctactacaaatcacaatcttctattaaatttttcttccatctctctgtataaactaaattataattggaatctccctattgccc

SEQ ID NO: 649 - protein, 167 aa, Panicum virgatum
  misc_feature (1)..(167): Ceres Clone ID no. 1724165
  misc_feature (108)..(146): Pfam Name: zf-AN1 Pfam Description: AN1-like Zinc finger
  misc_feature (21)..(42): Pfam Name: zf-A20 Pfam Description: A20-like zinc finger
  misc_feature (1)..(167): Bit score of 182.0 for HMM based on sequences of Figure 3
  misc_feature (1)..(167): Functional Homolog Of SEQ ID NO. 451
MAQRDKKVEEPTELHAPELTLCANSCGFPGNPATKNLCQNCFLAASASVSPPSPSSSPAVFDKPRTAAAAAAPPALWPPFSPAANRPPAGPAESPSKAPRTSSSVNRCHSCRKRVGLTGFRCRCGELFCGAHRYSDRHDCGYDYKGVARDAIARENPVVRAAKIVRF

SEQ ID NO: 650 - protein, 171 aa, Oryza sativa
  misc_feature (1)..(171): Public GI ID no. 35187687
  misc_feature (1)..(171): Oryza sativa Indica Group
  misc_feature (112)..(151): Pfam Name: zf-AN1 Pfam Description: AN1-like Zinc finger
  misc_feature (14)..(38): Pfam Name: zf-A20 Pfam Description: A20-like zinc finger
  misc_feature (1)..(171): Bit score of 381.0 for HMM based on sequences of Figure 3
  misc_feature (1)..(171): Functional Homolog Of SEQ ID NO. 451
MEHKETGCQQPKGPILCINNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCAMHRYSDKHDCQFDYRTAARDAIAKANPVVKAEKLDKI

SEQ ID NO: 651 - protein, 171 aa, Oryza sativa
  misc_feature (1)..(171): Public GI ID no. 125556051
  misc_feature (1)..(171): Oryza sativa Indica Group
  misc_feature (112)..(151): Pfam Name: zf-AN1 Pfam Description: AN1-like Zinc finger
  misc_feature (20)..(38): Pfam Name: zf-A20 Pfam Description: A20-like zinc finger
  misc_feature (1)..(171): Bit score of 317.8 for HMM based on sequences of Figure 3
  misc_feature (1)..(171): Functional Homolog Of SEQ ID NO. 451
  misc_feature (3)..(3): Xaa is any aa, unknown or other
MEXQGDWMPAARRPDPLHHNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCATHRYSDKHDCQFDYRTAARDAIAKANPVVKAEKLDKI

SEQ ID NO: 652 - protein, 223 aa, Oryza sativa
  misc_feature (1)..(223): Public GI ID no. 125561658
  misc_feature (1)..(223): Oryza sativa Indica Group
  misc_feature (164)..(203): Pfam Name: zf-AN1 Pfam Description: AN1-like Zinc finger
  misc_feature (18)..(42): Pfam Name: zf-A20 Pfam Description: A20-like zinc finger
  misc_feature (1)..(223): Bit score of 173.7 for HMM based on sequences of Figure 3
  misc_feature (1)..(223): Functional Homolog Of SEQ ID NO. 451
MEEQQAAAAGGGGGGGGASMCANGCGFFGSEATKKLCSKCYRDQLKAAPSSPPAAPDLVANEEEEASTAAAAADEQLALCSSGCGFFGSKETNNMCSKCYRDHLKATSPLFSSSSSPATASTTDITVPIAPATTAPTPSLKGKEEEATAAASSSAAAAAKPNRCVECRKKVGLLGFECRCGGTFCSTHRHADKHACTFDFKKSDREKIAKENPLIVAPKITKF

SEQ ID NO: 653 - protein, 161 aa, Oryza sativa
  misc_feature (1)..(161): Public GI ID no. 115470773
  misc_feature (1)..(161): Oryza sativa Japonica Group
  misc_feature (102)..(141): Pfam Name: zf-AN1 Pfam Description: AN1-like Zinc finger
  misc_feature (20)..(44): Pfam Name: zf-A20 Pfam Description: A20-like zinc finger
  misc_feature (1)..(161): Bit score of 323.2 for HMM based on sequences of Figure 3
  misc_feature (1)..(161): Functional Homolog Of SEQ ID NO. 451
MAQESWKNESEETVHTPEAPILCVNNCGFFGSSMTNNMCSKCYRDFVKVTTMAAPVVEKKAFTPASSSKTPLEPAKPDEVPAAAVEDKQAAQEPPKPPSNRCLSCRKKVGLTGFQCRCGGTFCSTHRYTEAHDCTFDYKKAGRDQIAKQNPVVIAEKINKI

SEQ ID NO: 654 - protein, 173 aa, Oryza sativa
  misc_feature (1)..(173): Public GI ID no. 115444813
  misc_feature (1)..(173): Oryza sativa Japonica Group
  misc_feature (114)..(153): Pfam Name: zf-AN1 Pfam Description: AN1-like Zinc finger
  misc_feature (14)..(38): Pfam Name: zf-A20 Pfam Description: A20-like zinc finger
  misc_feature (1)..(173): Bit score of 343.9 for HMM based on sequences of Figure 3
  misc_feature (1)..(173): Functional Homolog Of SEQ ID NO. 451
MEHKEAGCQQPEGPILCINNCGFFGSAATMNMCSKCHKEMIMKEEQAKLAASSIDSIVNGCDGGKEHIVAASGSTAVAVAQVEAKTLVVQPTDVAGTSEEVAVVPKVKEGPNRCATCRKRVGLTGFNCRCGNMYCALHRYSDKHECQFDYRTAARDAIAKANPVVKAEKLDKI

SEQ ID NO: 655 - protein, 154 aa, Oryza sativa
  misc_feature (1)..(154): Public GI ID no. 115446479
  misc_feature (1)..(154): Oryza sativa Japonica Group
  misc_feature (94)..(132): Pfam Name: zf-AN1 Pfam Description: AN1-like Zinc finger
  misc_feature (13)..(36): Pfam Name: zf-A20 Pfam Description: A20-like zinc finger
  misc_feature (1)..(154): Bit score of 266.7 for HMM based on sequences of Figure 3
  misc_feature (1)..(154): Functional Homolog Of SEQ ID NO. 451
MAEEQRWQEGCHRLCANNCGFFGSPATLDLCSKCYRDRQGRESTAPVVVAAAASACPATHPSSPSSSSCPAFLPSSTAAEAGVVVAAVAKASRCASCRKRVGLTGFACRCGGTFCGAHRYPERHACGFDFKAAGRDAIARANPLIKGDKLKDKI

SEQ ID NO: 656 - protein, 169 aa, Oryza sativa
  misc_feature (1)..(169): Public GI ID no. 115455855
  misc_feature (1)..(169): Oryza sativa Japonica Group
  misc_feature (109)..(148): Pfam Name: zf-AN1 Pfam Description: AN1-like Zinc finger
  misc_feature (22)..(45): Pfam Name: zf-A20 Pfam Description: A20-like zinc finger
  misc_feature (1)..(169): Bit score of 174.8 for HMM based on sequences of Figure 3
  misc_feature (1)..(169): Functional Homolog Of SEQ ID NO. 451
MASMKRKCPDDETACGSGAGAAMCVTGCGFFGSEATNNMCSRCYREHSADNDAVEEAAAANSDLELVGVAETTTKKARMSAVVPVAVASSSSAAAEQPAAKAATAPNRCAACRKKVGLTGFKCRCGGNFCGGHRHADAHGCGFDYKSAGKEQIAKQNPLVVADKLATRI

SEQ ID NO: 657 - protein, 164 aa, Oryza sativa
  misc_feature (1)..(164): Public GI ID no. 115479855
  misc_feature (1)..(164): Oryza sativa Japonica Group
  misc_feature (105)..(144): Pfam Name: zf-AN1 Pfam Description: AN1-like Zinc finger
  misc_feature (21)..(42): Pfam Name: zf-A20 Pfam Description: A20-like zinc finger
  misc_feature (1)..(164): Bit score of 180.3 for HMM based on sequences of Figure 3
  misc_feature (1)..(164): Functional Homolog Of SEQ ID NO. 451
MAQRDKKDQEPTELRAPEITLCANSCGFPGNPATQNLCQNCFLAATASTSSPSSLSSPVLDKQPPRPAAPLVEPQAPLPPPVEEMASALATAPAPVAKTSAVNRCSRCRKRVGLTGFRCRCGHLFCGEHRYSDRHGCSYDYKSAARDAIARDNPVVRAAKIVRF

SEQ ID NO: 658 - protein, 344 aa, Oryza sativa
  misc_feature (1)..(344): Public GI ID no. 57899571
  misc_feature (1)..(344): Oryza sativa Japonica Group
  misc_feature (284)..(323): Pfam Name: zf-AN1 Pfam Description: AN1-like Zinc finger
  misc_feature (191)..(215): Pfam Name: zf-A20 Pfam Description: A20-like zinc finger
  misc_feature (1)..(344): Bit score of 186.9 for HMM based on sequences of Figure 3
  misc_feature (1)..(344): Functional Homolog Of SEQ ID NO. 451
MPMLSSSPICAGRDSPAAPPPDPCLPPREEAGRGEEAAVRQMGSFTRCGRSLGHAAASSPPGLTRRDGGVELGAATTPPMLKRLPPPPLDRPAPLRSPPRFLCHCLATFGWWGIDRGEMKSPIKPRPPRPIDAIVFASIETRNRLRGFDRSFCCSAPPETYVFLPRARETIVLRANIIKMSSEQQASAGQPVLCASGCGFYGNPATLDMCSVCYRQHCLLNGATMATGPSSSVAAASAATVATGAVTSDSCSVPSAEVNGAAFSSKNNPEPATVVEKKAPANRCASCKKKVGLLGFACRCGATYCGTHRYPEKHACGFDFKGASRDAIARANPLIKGEKLTNKI

SEQ ID NO: 659 - DNA, 516 bp, Sorghum bicolor
  misc_feature (1)..(516): Ceres Annot ID no. 6035031
  misc_feature (1)..(516): Encodes the peptide sequence at SEQ ID NO. 660
atggagcacaaggagactggatgccaggcacctgagggacccatcctttgcatcaataactgcggcttcttcggcagcgcagctaccatgaacatgtgctccaagtgccacaaggagatgataatgaagcaggagcaggccaagctggctgcctcctctatcgacagcatcgtcaatggcaacgatgctgtcatggaaccagttgttgctggcaacacagtggtcgctgctgctccaatcgagttgcaaacaatgaacgtgcagcccgctgatgttgctggacctagcgagggggcggcggtgatctccaaagggaaggtagggccgaaccggtgcagcacttgcaggaagagggttggacttacaggattcaactgccggtgtgggaacttgtactgtgcactgcaccgctactccgacaagcacgactgcaagttcgactatcggactgctgctagggatgccattgccaaggctaatccagtggtgaaggcggacaagctcgacaagatctag

SEQ ID NO: 660 - protein, 171 aa, Sorghum bicolor
  misc_feature (1)..(171): Ceres Annot ID no. 6035031
  misc_feature (112)..(151): Pfam Name: zf-AN1 Pfam Description: AN1-like Zinc finger
  misc_feature (14)..(38): Pfam Name: zf-A20 Pfam Description: A20-like zinc finger
  misc_feature (1)..(171): Bit score of 357.1 for HMM based on sequences of Figure 3
  misc_feature (1)..(171): Functional Homolog Of SEQ ID NO. 451
MEHKETGCQAPEGPILCINNCGFFGSAATMNMCSKCHKEMIMKQEQAKLAASSIDSIVNGNDAVMEPVVAGNTVVAAAPIELQTMNVQPADVAGPSEGAAVISKGKVGPNRCSTCRKRVGLTGFNCRCGNLYCALHRYSDKHDCKFDYRTAARDAIAKANPVVKADKLDKI

SEQ ID NO: 661 - DNA, 834 bp, Sorghum bicolor
  misc_feature (1)..(834): Ceres Annot ID no. 6111586
  misc_feature (1)..(834): Encodes the peptide sequence at SEQ ID NO. 662
atggttcatagacaaaagaagagctcccctttctctacttttttctcaattaagaaaaatccctctctcaacatctcaaataaaagggagagcaactcccattctatcatgttggtgagcagatcaccacgtcgttcctctaggcacaccaagctcctcctcgcgattccaatccacgcacgcctcctccgcctccgcgtccgcctcgcgcaggtgatggaacacaaggaggcgggttgccagcagccggagggcccaatcctatgcatcaataactgcggtttctttggcagcgctgccaccatgaacatgtgctccaagtgccacaaggagatgataatgaagcaggagcaggcccagctggctgcctcctccattgatagcattgtcaatggtggtgatggtgggaaagggcctgtaattgccgcaactgtagatgcggcagttcctcaagttgaggagaagactattgttgtgcagcctatgcatgtagctgaaaccagcgaggctgctgctgtaatccccaaggccaaggaaggcccaaacaggtgtgcaacctgtaggaagcgtgttgggttgacaggatttaactgccgatgcgggaacatgtactgttcggtgcaccgctactccgacaaacatgactgccagttcgactatcgaactgcagctagggacgcgattgccaaggccaatcctgtggtgaaggcggagaactgcaagaattcgtccccagtcgagtccaaaatggtttgcgtgttggctatgtcgtgtaagcttattcagttattcatggtggtttcggtcggtattgtggcattcccatttaggtag

SEQ ID NO: 662 - protein, 277 aa, Sorghum bicolor
  misc_feature (1)..(277): Ceres Annot ID no. 6111586
  misc_feature (184)..(223): Pfam Name: zf-AN1 Pfam Description: AN1-like Zinc finger
  misc_feature (86)..(110): Pfam Name: zf-A20 Pfam Description: A20-like zinc finger
  misc_feature (1)..(277): Bit score of 315.0 for HMM based on sequences of Figure 3
  misc_feature (1)..(277): Functional Homolog Of SEQ ID NO. 451
MVHRQKKSSPFSTFFSIKKNPSLNISNKRESNSHSIMLVSRSPRRSSRHTKLLLAIPIHARLLRLRVRLAQVMEHKEAGCQQPEGPILCINNCGFFGSAATMNMCSKCHKEMIMKQEQAQLAASSIDSIVNGGDGGKGPVIAATVDAAVPQVEEKTIVVQPMHVAETSEAAAVIPKAKEGPNRCATCRKRVGLTGFNCRCGNMYCSVHRYSDKHDCQFDYRTAARDAIAKANPVVKAENCKNSSPVESKMVCVLAMSCKLIQLFMVVSVGIVAFPFR

SEQ ID NO: 663 - DNA, 435 bp, Sorghum bicolor
  misc_feature (1)..(435): Ceres Annot ID no. 6011488
  misc_feature (1)..(435): Encodes the peptide sequence at SEQ ID NO. 664
atggcacacgagagctggaaacaagagtccgaggagactggagaggccccaattcagtgcataaacaattgtggcttcttcggcagtagcatgacaaacaagatgtgctccaagtgctataaggacttcatcaagctacacgatgctcccgccgccgccgctgccgaagccgtagtagacaacaagcaagcagaagaagcagcggcacaggagcagcagcagcccccaaacccaaagccgccgagcaaccggtgcctgagctgccgcaagaaggtgggtctgactgggttccagtgccgctgcggcgggaccttctgctccacgcaccgctacacggactctcaccagtgcaccttcgactacaagacggcggccagggagcagatcgccaagcagaaccccgtcgtgatggccgacaagatcaacaagatctga

SEQ ID NO: 664 - protein, 144 aa, Sorghum bicolor
  misc_feature (1)..(144): Ceres Annot ID no. 6011488
  misc_feature (85)..(124): Pfam Name: zf-AN1 Pfam Description: AN1-like Zinc finger
  misc_feature (17)..(41): Pfam Name: zf-A20 Pfam Description: A20-like zinc finger
  misc_feature (1)..(144): Bit score of 263.5 for HMM based on sequences of Figure 3
  misc_feature (1)..(144): Functional Homolog Of SEQ ID NO. 451
MAHESWKQESEETGEAPIQCINNCGFFGSSMTNKMCSKCYKDFIKLHDAPAAAAAEAVVDNKQAEEAAAQEQQQPPNPKPPSNRCLSCRKKVGLTGFQCRCGGTFCSTHRYTDSHQCTFDYKTAAREQIAKQNPVVMADKINKI

SEQ ID NO: 665 - DNA, 516 bp, Sorghum bicolor
  misc_feature (1)..(516): Ceres Annot ID no. 6063958
  misc_feature (1)..(516): Encodes the peptide sequence at SEQ ID NO. 666
atggcggagaggcagcaggaggtctccggcggcggtgcagcggcgccgttgtgcgccaacggatgcgggttcttcgggagcgcggcgaccaagaacctctgctccaacatcaagtgcgcggcgaacgggtgcggtttcttcggatccacggcgaccaagaacatgtgctccggctgctacagggacttcctcaaagacgctcacgcctcccctgctgtggcggacaaggtcgtcctcgcggccgagcagctggcggcggtccagatctctgctgcaacctccagtgctgcaccagcggtggaggcggcgccggcggcggcgcccaccaacaggtgcgcgtcgtgccgaaagaaggtggggctgctggggttcccctgccgctgcggcggcacgttctgctccctgcaccggtacgcggagaagcacgcctgcgacttcgacttcaaggcggcgggccgggagaagatcgccaagaacaacccgctcgtcgtggcagccaagatcaacaagatctga

SEQ ID NO: 666 - protein, 171 aa, Sorghum bicolor
  misc_feature (1)..(171): Ceres Annot ID no. 6063958
  misc_feature (112)..(150): Pfam Name: zf-AN1 Pfam Description: AN1-like Zinc finger
  misc_feature (37)..(61): Pfam Name: zf-A20 Pfam Description: A20-like zinc finger
  misc_feature (1)..(171): Bit score of 190.3 for HMM based on sequences of Figure 3
  misc_feature (1)..(171): Functional Homolog Of SEQ ID NO. 451
MAERQQEVSGGGAAAPLCANGCGFFGSAATKNLCSNIKCAANGCGFFGSTATKNMCSGCYRDFLKDAHASPAVADKVVLAAEQLAAVQISAATSSAAPAVEAAPAAAPTNRCASCRKKVGLLGFPCRCGGTFCSLHRYAEKHACDFDFKAAGREKIAKNNPLVVAAKINKI

SEQ ID NO: 667 - DNA, 582 bp, Sorghum bicolor
  misc_feature (1)..(582): Ceres Annot ID no. 6063957
  misc_feature (1)..(582): Encodes the peptide sequence at SEQ ID NO. 668
atggcggagaggcaggaggtctctggcggcatggcggcgccgatgtgcgccaacgcctgcgggttcttcgggagtgcggcgaccaagaacctctgctccaagtgctacaaggagcacctgatcaagaccgccaagcaggaagcatccgccgccgtcgtcgtcggcggcgccatcgtcaagtgcgcggccgacgggtgcggtttcttcggatcctcggcgaccaacaacatgtgctccggctgctacatggacttcctcaaagacgctcacgcctcccctgctgtggcggacaaggtcgtcgtactcgctgccgagaagcagccggcggcggcccagatctctgctgcaacgtccagtactgcaccggcggcggtgaaggcggcggcggcgcccaacaggtgcgcgtcgtgccgcaagaaggtggggctgctggggttcccctgccgctgcggcggcacgttctgcgcgctgcaccggtacgcggagaagcacgcctgcgacttcgacttcaaggcggcgggccgggagaagatcgccaagaacaacccgctcgtcgtggcagccaagatcaacaagatctga

SEQ ID NO: 668 - protein, 193 aa, Sorghum bicolor
  misc_feature (1)..(193): Ceres Annot ID no. 6063957
  misc_feature (134)..(172): Pfam Name: zf-AN1 Pfam Description: AN1-like Zinc finger
  misc_feature (13)..(37): Pfam Name: zf-A20 Pfam Description: A20-like zinc finger
  misc_feature (1)..(193): Bit score of 203.6 for HMM based on sequences of Figure 3
  misc_feature (1)..(193): Functional Homolog Of SEQ ID NO. 451
MAERQEVSGGMAAPMCANACGFFGSAATKNLCSKCYKEHLIKTAKQEASAAVVVGGAIVKCAADGCGFFGSSATNNMCSGCYMDFLKDAHASPAVADKVVVLAAEKQPAAAQISAATSSTAPAAVKAAAAPNRCASCRKKVGLLGFPCRCGGTFCALHRYAEKHACDFDFKAAGREKIAKNNPLVVAAKINKI

SEQ ID NO: 669 - protein, 137 aa, Gossypium hirsutum
  misc_feature (1)..(137): Public GI ID no. 38016527
  misc_feature (10)..(34): Pfam Name: zf-A20 Pfam Description: A20-like zinc finger
  misc_feature (103)..(130): Pfam Name: zf-AN1 Pfam Description: AN1-like Zinc finger
  misc_feature (1)..(137): Bit score of 182.4 for HMM based on sequences of Figure 3
  misc_feature (1)..(137): Functional Homolog Of SEQ ID NO. 451
MAEEHRCQAPQLCANNCGFFGSPTTQNLCSECYRGLQLKEQQSSSAKQAFNHTLVPSSSSLPSSSSARSSFSASLPAKEEPSAGTKETKVVEEEEVQVTPNRCLSCKKRVGLTGFKCRCGMVFCGIHRYPGTTCLCF

SEQ ID NO: 670 - protein, 224 aa, Oryza sativa
  misc_feature (1)..(224): Public GI ID no. 75133829
  misc_feature (1)..(224): Oryza sativa Japonica Group
  misc_feature (165)..(204): Pfam Name: zf-AN1 Pfam Description: AN1-like Zinc finger
  misc_feature (18)..(42): Pfam Name: zf-A20 Pfam Description: A20-like zinc finger
  misc_feature (1)..(224): Bit score of 176.6 for HMM based on sequences of Figure 3
  misc_feature (1)..(224): Functional Homolog Of SEQ ID NO. 451
MEEQQAAAAGGGGGGGGASMCANGCGFFGSEATKKLCSKCYRDQLKAAPSSPPAAPDLVANEEEEASTAAAAAADEQLALCSSGCGFFGSKETNNMCSKCYRDHLKATSPLFSSSSSPATASTTDITVPIAPATTAPTPSLKGKEEEATAAASSSAAAAAKPNRCVACRKKVGLLGFECRCGGTFCSTHRHADKHACTFDFKKSDREKIAKENPLIVAPKITKF

SEQ ID NO: 671 - protein, 238 aa, Oryza sativa
  misc_feature (1)..(238): Public GI ID no. 125546011
  misc_feature (1)..(238): Oryza sativa Indica Group
  misc_feature (178)..(217): Pfam Name: zf-AN1 Pfam Description: AN1-like Zinc finger
  misc_feature (22)..(45): Pfam Name: zf-A20 Pfam Description: A20-like zinc finger
  misc_feature (1)..(238): Bit score of 100.3 for HMM based on sequences of Figure 3
  misc_feature (1)..(238): Functional Homolog Of SEQ ID NO. 451
MATKRKCPANGDDGGVADLEPVAGGSFASRPPEKKAKLTVAVAVAVAPSSSSSATTAAAGEATAKREHGGFFAFARPENNTRLSVAVASSFSSASAAAEKAMAKLTVAGVAPSSSSASAAAAGKATAKLEYGGFCAFARPDDKTRWRVAVASSAAAAADASYSSSSPATGEQPEANRCATCRRKVGLTGFKCRCGGTFCGGHRYADEHGCGFDYKSSGRELIAKQNPVVVADKLAFRI

SEQ ID NO: 672 - protein, 180 aa, Picea sitchensis
  misc_feature (1)..(180): Public GI ID no. 116778802
  misc_feature (121)..(160): Pfam Name: zf-AN1 Pfam Description: AN1-like Zinc finger
  misc_feature (22)..(45): Pfam Name: zf-A20 Pfam Description: A20-like zinc finger
  misc_feature (1)..(180): Bit score of 265.0 for HMM based on sequences of Figure 3
  misc_feature (1)..(180): Functional Homolog Of SEQ ID NO. 451
MAQESWNREKEETGCQVPEGLIRCANNCGFFGSPATMSLCSKCYREFVLLNSPKSSFDKPQQQQIQGEVSIPRPDVGDEEIRSKYLAVDGSGPSCSTAAHQLEPQQQQNPPPPPPRQTNRCFSCRKRVGLTGFRCRCGDMFCALHRYSDKHNCTYDYKTAGREAIAKANPLVKADKILRF

SEQ ID NO: 673 - protein, 170 aa, Picea sitchensis
  misc_feature (1)..(170): Public GI ID no. 116778893
  misc_feature (111)..(150): Pfam Name: zf-AN1 Pfam Description: AN1-like Zinc finger
  misc_feature (21)..(45): Pfam Name: zf-A20 Pfam Description: A20-like zinc finger
  misc_feature (1)..(170): Bit score of 290.6 for HMM based on sequences of Figure 3
  misc_feature (1)..(170): Functional Homolog Of SEQ ID NO. 451
MAQESWKNMGEDRGRQPPGGPVLCSNKCGFFGSSATMNMCSKCYRDHFLAQTQASAVKSAVEKSLSLDIDSSKALRFDATGVRNPAEIVGSSSDDGNSVSSEEPPRVSNRCQSCRKRVGLTGFKCRCGYVFCSLHRYSDKHGCSFDYKEAGRQEIEKANPVVKAEKIQKI

SEQ ID NO: 674 - protein, 168 aa, Brassica rapa
  misc_feature (1)..(168): Public GI ID no. 157849766
  misc_feature (109)..(146): Pfam Name: zf-AN1 Pfam Description: AN1-like Zinc finger
  misc_feature (15)..(39): Pfam Name: zf-A20 Pfam Description: A20-like zinc finger
  misc_feature (1)..(168): Bit score of 277.9 for HMM based on sequences of Figure 3
  misc_feature (1)..(168): Functional Homolog Of SEQ ID NO. 451
MDHDKTGCQSPPEGPKLCINNCGFFGSAATMNMCSKCHKTILFQQEQGAKLASAVSGSPSNILKETFTAALVDAETKSIEPVAVSVQAVAEVVAPEEAAAKPKEGPSRCTTCNKRVGLTGFKCRCGDLFCGTHRYADVHNCSFDYHVAAQEAIAKANPVVKADKLDKI

SEQ ID NO: 675 - protein, 160 aa, Chlamydomonas reinhardtii
  misc_feature (1)..(160): Public GI ID no. 159474166
  misc_feature (101)..(139): Pfam Name: zf-AN1 Pfam Description: AN1-like Zinc finger
  misc_feature (9)..(33): Pfam Name: zf-A20 Pfam Description: A20-like zinc finger
  misc_feature (1)..(160): Bit score of 130.6 for HMM based on sequences of Figure 3
  misc_feature (1)..(160): Functional Homolog Of SEQ ID NO. 451
MEREQASSPQLCEKGCGFFANVGCGGMCSKCHREEARQHANAQATSSQPKPVEVAASRPVHESFPQPAAPSEAVASPVAEASTSSGDASPSATKSANPSRCLCCKKKVGLTGFKCKCGDVFCGTHRYAESHNCPFDYKTVHKEKLASNNPVVQASKVQKI

SEQ ID NO: 676 - protein, 188 aa, Physcomitrella patens
  misc_feature (1)..(188): Public GI ID no. 168036656
  misc_feature (1)..(188): Physcomitrella patens subsp. patens
  misc_feature (129)..(168): Pfam Name: zf-AN1 Pfam Description: AN1-like Zinc finger
  misc_feature (18)..(42): Pfam Name: zf-A20 Pfam Description: A20-like zinc finger
  misc_feature (1)..(188): Bit score of 222.0 for HMM based on sequences of Figure 3
  misc_feature (1)..(188): Functional Homolog Of SEQ ID NO. 451
MATERVSQETTSQAPEGPVMCKNLCGFFGSQATMGLCSKCYRETVMQAKMTALAEQATQAAQATSATAAAVQPPAPVHETKLTCEVERTMIVPHQSSSYQQDLVTPAAAAPQAVKSSIAAPSRPEPNRCGSCRKRVGLTGFKCRCGNLYCALHRYSDKHTCTYDYKAAGQEAIAKANPLVVAEKVVKF

SEQ ID NO: 677 - protein, 172 aa, Physcomitrella patens
  misc_feature (1)..(172): Public GI ID no. 168053490
  misc_feature (1)..(172): Physcomitrella patens subsp. patens
  misc_feature (21)..(45): Pfam Name: zf-A20 Pfam Description: A20-like zinc finger
  misc_feature (113)..(150): Pfam Name: zf-AN1 Pfam Description: AN1-like Zinc finger
  misc_feature (1)..(172): Bit score of 250.7 for HMM based on sequences of Figure 3
  misc_feature (1)..(172): Functional Homolog Of SEQ ID NO. 451
MAQYGRKPDTEETNCQVPEGPVRCTNNCGFFGSAVTMGMCSKCYRDFVLSQSRTSSAKIAGASPPVYETQEPVADRAQIQNSCLSSTQPEAAGASSGASASGQDPSRSRPNRCFSCKKRLGLTGFECRCGNLFCSAHRYSDKHSCTFDYKLAGRDSISKANPVVKADKINKI

SEQ ID NO: 678 - DNA, 902 bp, Zea mays
  misc_feature (1)..(902): Ceres Clone ID no. 100879386
  misc_feature (1)..(902): Encodes the peptide sequence at SEQ ID NO. 679
tatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgcctcctccatcgatagcattgtcaatggcggtgataatgggaaaggacctgcaattgctgcaactgtaggtgtggcagttcctcaagtcgaggagaagactatcgccgtgcagcctatgcatgtcgctgaaaccagcgaggctgctgctgttatcgcgaaggccaaggaaggcccaaaccggtgcgcaacctgtaggaagcgtgttgggttgacgggttttaactgccgatgcgggaacacgtactgttcgatgcaccgctactccgacaaacacgactgccagttcgactatcgaactgcagctagggacgctatcgccaaggccaatccagtggtgaaggcggagaagcttgacaagatctgaggcgggggcattgggtaacgaaaaatggttgcgatctgcaagaattcagcatgtctctttgctgctttatcattgaacttcccattcttgtcttgctgtcacgtcccctggggttcaatactatgatgcgcacagcatcctggcagctgcaagaattcatccccagtcgagtcacgaaaatggtttgcgtgttgactatgtcgtgtaagcttattcagttattcttggtggtttgggtcggtatcgtgtcattccccgtttaggtagctctgtaatctactattctcaatttctcatgtgtgttgccttccaatcagtaatagtaatcagcaattgtctgccatatctcctacaagtatattttccagttctatt

SEQ ID NO: 679 - protein, 171 aa, Zea mays
  misc_feature (1)..(171): Ceres Clone ID no. 100879386
  misc_feature (112)..(151): Pfam Name: zf-AN1 Pfam Description: AN1-like Zinc finger
  misc_feature (14)..(38): Pfam Name: zf-A20 Pfam Description: A20-like zinc finger
  misc_feature (1)..(171): Bit score of 345.8 for HMM based on sequences of Figure 3
  misc_feature (1)..(171): Functional Homolog Of SEQ ID NO. 451
MEHKEAGCQQPEGPILCINNCGFFGSAATMNMCSKCHKEMIMKQEQAQLAASSIDSIVNGGDNGKGPAIAATVGVAVPQVEEKTIAVQPMHVAETSEAAAVIAKAKEGPNRCATCRKRVGLTGFNCRCGNTYCSMHRYSDKHDCQFDYRTAARDAIAKANPVVKAEKLDKI

SEQ ID NO: 680 - DNA, 784 bp, Musa acuminata
  misc_feature (1)..(784): Ceres Clone ID no. 1738028
  misc_feature (1)..(784): Encodes the peptide sequence at SEQ ID NO. 681
acgatgagaccggatgccaagcacgtgaaggaccaatcctttgcatcaacaactgtggattcttcggaagtgccgcaaccatgaacttgtgctccaagtgccacaaggacatgattctcaagcaggaacaggccaagatggcggcatcctcgatcgacagcctcgtgaatggcaatggcaatggcagtggcagtggaaaagagcccgtcgtttcgggtaatgctgttgttgctgttggctccatggagccgaaagtgatttcagcacagtcatccgatgctttagcctcaaacgaggccggagaggcaaaggcgaaggagggtccaaacaggtgtggcacctgcaggaaacgcgttggtctgactggtttcagttgtcggtgtgggaaccttttctgtgctgtgcaccgctactcggataagcacgactgccaattcgactaccgaaaggcggcccaggatgcaattgccaaagcaaaccctgtcattaaggccgaaaagcttgataagatctagagatatgggttaaaggttaatgaactctgttccgatgatctccacgttatcatcatgccttttctttcggttggctggatgttggtgtcttttgatcctatatatatggctggaggaatgatgcatggggcatccttgcagcctctcaagaacctctatcttgttgattggaaaaggtttgcatgttggatctggtgtgtaatctttaatttgtgctggtttgcatggtggatgagtacaacgttatgctttagttaggtttgtgactt

SEQ ID NO: 681 - protein, 144 aa, Musa acuminata
  misc_feature (1)..(144): Ceres Clone ID no. 1738028
  misc_feature (85)..(124): Pfam Name: zf-AN1 Pfam Description: AN1-like Zinc finger
  misc_feature (3)..(20): Pfam Name: zf-A20 Pfam Description: A20-like zinc finger
  misc_feature (1)..(144): Bit score of 207.3 for HMM based on sequences of Figure 3
  misc_feature (1)..(144): Functional Homolog Of SEQ ID NO. 451
MNLCSKCHKDMILKQEQAKMAASSIDSLVNGNGNGSGSGKEPVVSGNAVVAVGSMEPKVISAQSSDALASNEAGEAKAKEGPNRCGTCRKRVGLTGFSCRCGNLFCAVHRYSDKHDCQFDYRKAAQDAIAKANPVIKAEKLDKI

SEQ ID NO: 682 - DNA, 668 bp, Miscanthus x giganteus
  misc_feature (1)..(668): Ceres Clone ID no. 2055733
  misc_feature (1)..(668): Encodes the peptide sequence at SEQ ID NO. 683
tttttttcgaagcccaccgaattccctgcgattcctctcccctcgcctcctcgtcttcctctaggggatcgccggagaggaatcgcagagggccgtctcatccgagttaaggaagccatggagcacaaggagactggatgccaggcccccgagggacccatcctttgcatcaataactgcggcttcttcggaagcgcagctaccatgaacatgtgctccaagtgccacaaggagatgataatgaagcaggagcaggccaagctggctgcctcctctatcgacagcatcgtcaatggcaacgatgctgtcatggaaccagttgttgctggcaacacagtggtagctgttgctccagttgagttgcaaacaatgaacgtgcagcccactgatgttgctggacctagcgagggggcggcggtgatctccaaagggaaggtagggccaaaccggtgcagcacttgcaggaagagggttggacttacaggattcaactgccggtgtgggaacttgtactgtgcactccaccgctactccgacaagcatgactgcaagtttgactatcggactgctgctagggatgccattgccaaggctaatccagtggtgaaggcggacaagctcgacaagatctagggtttcctacggttggctcaggaagattgcaacct

SEQ ID NO: 683 - protein, 171 aa, Miscanthus x giganteus
  misc_feature (1)..(171): Ceres Clone ID no. 2055733
  misc_feature (112)..(151): Pfam Name: zf-AN1 Pfam Description: AN1-like Zinc finger
  misc_feature (14)..(38): Pfam Name: zf-A20 Pfam Description: A20-like zinc finger
  misc_feature (1)..(171): Bit score of 356.5 for HMM based on sequences of Figure 3
  misc_feature (1)..(171): Functional Homolog Of SEQ ID NO. 451
MEHKETGCQAPEGPILCINNCGFFGSAATMNMCSKCHKEMIMKQEQAKLAASSIDSIVNGNDAVMEPVVAGNTVVAVAPVELQTMNVQPTDVAGPSEGAAVISKGKVGPNRCSTCRKRVGLTGFNCRCGNLYCALHRYSDKHDCKFDYRTAARDAIAKANPVVKADKLDKI

SEQ ID NO: 684 - DNA, 723 bp, Miscanthus x giganteus
  misc_feature (1)..(723): Ceres Clone ID no. 2056478
  misc_feature (1)..(723): Encodes the peptide sequence at SEQ ID NO. 685
catttcgaagcccaccgaactccctgcgattcctctcccctcgcctcctcgtcttcccctaggggatcgccggagaggaatcgcaaagagggccgtctcgtccgagttaaggaagccatggagcacaaggagactggatgccaggctcccatcctttgcatcaataactgcggcttcttcggcagtgcagctaccatgaacatgtgctccaagtgccacaaggagatgataacgaagcaggaccatgccaagctggctgcctcctctatcgacagcatcgtcaatggcaacgatgctgtcatggaaccagttgtttctggcaacacagtggtagctgttgctcaagttgagttgcaaacgatgaacgtgcagcccactgatgttgctggacctagcgagggggcggcggtgatctccaaagggaaggtagggccgaaccggtgcagcacttgcaggaagagggttagacttacagggttcaactgccggtgtgggaacttgtactgtgcactccaccgctactccgacaagcatgactgcaagtttgactatcggactgctgctagggatgccattgccaaggctaatccagtggtgaaggcggacaagctcgacaagatctagggtttcctacggttggctcaaggaagattgcaacctgtggtacttcttcatcatgcgggattgctgctttgcccatgcctttccctttcatgtttgctg

SEQ ID NO: 685 - protein, 168 aa, Miscanthus x giganteus
  misc_feature (1)..(168): Ceres Clone ID no. 2056478
  misc_feature (11)..(35): Pfam Name: zf-A20 Pfam Description: A20-like zinc finger
  misc_feature (109)..(148): Pfam Name: zf-AN1 Pfam Description: AN1-like Zinc finger
  misc_feature (1)..(168): Bit score of 324.8 for HMM based on sequences of Figure 3
  misc_feature (1)..(168): Functional Homolog Of SEQ ID NO. 451
MEHKETGCQAPILCINNCGFFGSAATMNMCSKCHKEMITKQDHAKLAASSIDSIVNGNDAVMEPVVSGNTVVAVAQVELQTMNVQPTDVAGPSEGAAVISKGKVGPNRCSTCRKRVRLTGFNCRCGNLYCALHRYSDKHDCKFDYRTAARDAIAKANPVVKADKLDKI

SEQ ID NO: 686 - protein, 161 aa, Arabidopsis lyrata
  misc_feature (1)..(161): Public GI ID no. 297823437
  misc_feature (1)..(161): Arabidopsis lyrata subsp. lyrata
  misc_feature (102)..(141): Pfam Name: zf-AN1 Pfam Description: AN1-like Zinc finger
  misc_feature (14)..(36): Pfam Name: zf-A20 Pfam Description: A20-like zinc finger
  misc_feature (1)..(161): Bit score of 399.2 for HMM based on sequences of Figure 3
  misc_feature (1)..(161): Functional Homolog Of SEQ ID NO. 451
MAEEHRCETPEGHRLCVNNCGFFGSSATMNLCSNCYGDLCLKQQQQASIKSTVESSRSPVIAPVLENYAAELEIPTTKTEEKKPVQNPTEQPPPPPQRPNRCTVCRKRVGLTGFMCRCGTTFCGSHRYPEVHGCTFDFKSAGREEIAKANPLVIAAKLQKI

SEQ ID NO: 687 - protein, 169 aa, Arabidopsis lyrata
  misc_feature (1)..(169): Public GI ID no. 297816570
  misc_feature (1)..(169): Arabidopsis lyrata subsp. lyrata
  misc_feature (110)..(149): Pfam Name: zf-AN1 Pfam Description: AN1-like Zinc finger
  misc_feature (14)..(36): Pfam Name: zf-A20 Pfam Description: A20-like zinc finger
  misc_feature (1)..(169): Bit score of 361.8 for HMM based on sequences of Figure 3
  misc_feature (1)..(169): Functional Homolog Of SEQ ID NO. 451
MAEEHRCQTPESNRLCVNNCGFLGSSATMNLCSNCYGDLCLKQQQQSSIKSTVESSLSVSPPSSSSEIASISSPIIPPLLKTPSVKLEVPEKKPVNSPPEQNQQQRPNRCTTCRKRVGLTGFKCRCGTMYCGVHRYPEIHGCSYDFKSAGREEIAKANPLVKAAKLQKI

SEQ ID NO: 688 - DNA, 536 bp, Brassica napus
  misc_feature (1)..(536): Ceres Clone ID no. 1428270
  misc_feature (1)..(536): Encodes the peptide sequence at SEQ ID NO. 689
agcaaaaaaaaaaaaataagtgaatcatctttcttcatctttcttcatctctctcaagaacagattttcgacgagcttgatcgatctaaattctcaagatctatggcggaagagcatcgatgtcagacgccggaaggccaccgtctatgtgctaacaactgcggcttcctcggcagctccgccaccatgaatctctgctccaattgctacggcgatctctgtcttaagcaacagcaacaagcttccataaaaaccaccgttgaatcctctctctcctccgtatctcctccgtcgacggaggtagcttccgtctcttctccggtgatctcacctctcgttcaaaacccattagccgaactggaggtaacgacgaaaaacgttccggcgacgtttactccgccgccgcagacaacgacggaggataagcagctgaaacggccgaatcgctgcacgacgtgcaggaaacgggtcgggttaaccgggtttaagtgccggtgcgggacgactttctgcggggtccacaggtacccggaggt

SEQ ID NO: 689 - protein, 144 aa, Brassica napus
  misc_feature (1)..(144): Ceres Clone ID no. 1428270
  misc_feature (14)..(36): Pfam Name: zf-A20 Pfam Description: A20-like zinc finger
  misc_feature (116)..(144): Pfam Name: zf-AN1 Pfam Description: AN1-like Zinc finger
  misc_feature (1)..(144): Bit score of 227.4 for HMM based on sequences of Figure 3
  misc_feature (1)..(144): Functional Homolog Of SEQ ID NO. 451
MAEEHRCQTPEGHRLCANNCGFLGSSATMNLCSNCYGDLCLKQQQQASIKTTVESSLSSVSPPSTEVASVSSPVISPLVQNPLAELEVTTKNVPATFTPPPQTTTEDKQLKRPNRCTTCRKRVGLTGFKCRCGTTFCGVHRYPE

SEQ ID NO: 690 - DNA, 615 bp, Brassica napus
  misc_feature (1)..(615): Ceres Clone ID no. 1447811
  misc_feature (1)..(615): Encodes the peptide sequence at SEQ ID NO. 691
atctctgtttggttgccgagaaagcggaggaaaattttcttcgctttttattaccgatctttctgttttttttcttttgttctgtttctctcggtgaccagattcctgtaaagcctcgaactttctctatggcggaagagcatcgatgccagacgccggaaggccaccgtctctgtgctaacaactgcggcttcctcggcagctccgccaccatgaatctatgctccaactgctacggcgatctctgccttaagcaacagcaagcttccatgaaatccaccgtcgaatcctctctctccgccgtatctcctccgtcgtcagagatcggctctatgcaatccaccgttgaatcctctctctccgacgtatctcctccatcaccggagaccatttccatctcctctccaatgatccagcctctcgttcgaaacccatcagctgaattggaggtaacggcgacgaagacggtgactccgccgccggagcagcagcagaaacggccgaatcggtgcacgacgtgtaggaaacgggtcgggttgaccgggttcaagtgccggtgcgggacgactttttgcggggctcacaggtacccggaagtccatggatgcaccttcg

SEQ ID NO: 691 - protein, 162 aa, Brassica napus
  misc_feature (1)..(162): Ceres Clone ID no. 1447811
  misc_feature (128)..(162): Pfam Name: zf-AN1 Pfam Description: AN1-like Zinc finger
  misc_feature (14)..(36): Pfam Name: zf-A20 Pfam Description: A20-like zinc finger
  misc_feature (1)..(162): Bit score of 234.2 for HMM based on sequences of Figure 3
  misc_feature (1)..(162): Functional Homolog Of SEQ ID NO. 451
MAEEHRCQTPEGHRLCANNCGFLGSSATMNLCSNCYGDLCLKQQQASMKSTVESSLSAVSPPSSEIGSMQSTVESSLSDVSPPSPETISISSPMIQPLVRNPSAELEVTATKTVTPPPEQQQKRPNRCTTCRKRVGLTGFKCRCGTTFCGAHRYPEVHGCTF

SEQ ID NO: 692 - DNA, 486 bp, Brassica napus
  misc_feature (1)..(486): Ceres Clone ID no. 1093477
  misc_feature (1)..(486): Encodes the peptide sequence at SEQ ID NO. 693
atttctgttttattttggttgccgagaaaacgcaggaactcggtgacctaattatagtctcgtcgattgtctttttcagaattttcgacgaattttattgattaataattaattaatggcggaagaacatccatgtcagacgccggaaggccaccgtctctgcgttaacaactgcggtttcttcggaagctcagccaccatgaatctctgctccaactgctacggcgacctctgcctcaagaaccagcagcaagcttccatgaaatcaaccgtcgagtcctccctctccgccgcatctcctccgtcgtcaccggagatccagtcaatctccacgtcgacgatcgcgcccgtcgtccaaatttacgcggcggagatacagatagagaaacaaatccagcagcaacggcctaatcggtgcaccgtgtgcaggaaacgggtcgggttaaccgggttcatgtgccggtgcgggacgactttctgcgggac

SEQ ID NO: 693 - protein, 123 aa, Brassica napus
  misc_feature (1)..(123): Ceres Clone ID no. 1093477
  misc_feature (14)..(36): Pfam Name: zf-A20 Pfam Description: A20-like zinc finger
  misc_feature (101)..(122): Pfam Name: zf-AN1 Pfam Description: AN1-like Zinc finger
  misc_feature (1)..(123): Bit score of 198.4 for HMM based on sequences of Figure 3
  misc_feature (1)..(123): Functional Homolog Of SEQ ID NO. 451
MAEEHPCQTPEGHRLCVNNCGFFGSSATMNLCSNCYGDLCLKNQQQASMKSTVESSLSAASPPSSPEIQSISTSTIAPVVQIYAAEIQIEKQIQQQRPNRCTVCRKRVGLTGFMCRCGTTFCG

SEQ ID NO: 694 - DNA, 466 bp, Brassica napus
  misc_feature (1)..(466): Ceres Clone ID no. 1260056
  misc_feature (1)..(466): Encodes the peptide sequence at SEQ ID NO. 695
accctttatagaaaagaaccagtgaatcatcatcatcatcatcatcatcatcatcttccttcttcttctccaaaaacagattttcgaccaaacttgatctgttctgtccaaagcttattattataatcaatggcggaagaacatcgatgccaaacgccagaaggccaccgtctctgcgttaacaactgcggtttctccggcagctcagccaccatgaacctctgctccaattgctacggcgatctctgcctcaaccaacagcaagcctcctctctccccgccgcatctcctccgtcctcatcaaagatcgaatccatctcatcgtcttcaacggcggagagacaaattaagctgatcccgtcggagcagaagcagccgccgcaacgggctaaccggtgcaccgtgtgcaggaaacgggtcgggttgaccggattcatgtgccggtgcggtacgactttctgcggga

SEQ ID NO: 695 - protein, 112 aa, Brassica napus
  misc_feature (1)..(112): Ceres Clone ID no. 1260056
  misc_feature (14)..(36): Pfam Name: zf-A20 Pfam Description: A20-like zinc finger
  misc_feature (90)..(111): Pfam Name: zf-AN1 Pfam Description: AN1-like Zinc finger
  misc_feature (1)..(112): Bit score of 162.4 for HMM based on sequences of Figure 3
  misc_feature (1)..(112): Functional Homolog Of SEQ ID NO. 451
MAEEHRCQTPEGHRLCVNNCGFSGSSATMNLCSNCYGDLCLNQQQASSLPAASPPSSSKIESISSSSTAERQIKLIPSEQKQPPQRANRCTVCRKRVGLTGFMCRCGTTFCG

SEQ ID NO: 696 - protein, 172 aa, Ricinus communis
  misc_feature (1)..(172): Public GI ID no. 255565591
  misc_feature (113)..(151): Pfam Name: zf-AN1 Pfam Description: AN1-like Zinc finger
  misc_feature (11)..(34): Pfam Name: zf-A20 Pfam Description: A20-like zinc finger
  misc_feature (1)..(172): Bit score of 340.9 for HMM based on sequences of Figure 3
  misc_feature (1)..(172): Functional Homolog Of SEQ ID NO. 451
MAEEHRCQAQRLCVNNCGFFGSPATQNLCSKCHRDLQLKEQQSSNAKLAFSQTLSASSSSSSSSSSSPSAASVSISISSPPIVDLPEVSSKAEVVVEDKEETAAETVVRPNRCLTCRKRVGLTGFKCRCEMVFCGTHRYPEQHGCTFDFKAMGKKQIAKANPVVKAEKLEKI

SEQ ID NO: 697 - DNA, 700 bp, Glycine max; identical to SEQ ID NO: 565
  misc_feature (1)..(700): Ceres Clone ID no. 1626661
  misc_feature (1)..(700): Encodes the peptide sequence at SEQ ID NO. 698
  misc_feature (590)..(590): n is a, c, t, g, unknown, or other

SEQ ID NO: 698 - protein, 184 aa, Glycine max; identical to SEQ ID NO: 566
  misc_feature (1)..(184): Ceres Clone ID no. 1626661
  misc_feature (113)..(151): Pfam Name: zf-AN1 Pfam Description: AN1-like Zinc finger
  misc_feature (14)..(36): Pfam Name: zf-A20 Pfam Description: A20-like zinc finger
  misc_feature (1)..(184): Bit score of 251.0 for HMM based on sequences of Figure 3
  misc_feature (1)..(184): Functional Homolog Of SEQ ID NO. 451
  misc_feature (148)..(148): Xaa is any aa, unknown or other

SEQ ID NO: 699 - protein, 151 aa, Solanum lycopersicum
  misc_feature (1)..(151): Public GI ID no. 222822665
  misc_feature (92)..(130): Pfam Name: zf-AN1 Pfam Description: AN1-like Zinc finger
  misc_feature (16)..(39): Pfam Name: zf-A20 Pfam Description: A20-like zinc finger
  misc_feature (1)..(151): Bit score of 249.2 for HMM based on sequences of Figure 3
  misc_feature (1)..(151): Functional Homolog Of SEQ ID NO. 451
MAEEHEFQSQEGGRHQLCANNCGFFGNSTTENYCSKCYRDIEKQKSDAKSIDSLFSPIKKVSEKKIIEPIVLTTDTMKTTTSNVVTPQSNRCLVCKKKMGLMGFRCKCGTIFCGTHRYPEVHACTFDFKSMGREAIAKANPLIKAEKLKKI

SEQ ID NO: 700 - DNA, 1498 bp, Gossypium hirsutum
  misc_feature (1)..(1498): Ceres Clone ID no. 1842119
  misc_feature (1)..(1498): Encodes the peptide sequence at SEQ ID NO. 701
aaggcccatccaaccccgatgctatcccttgcctttcttctggcttcaattcgcaccttgctctgcgaattctcaatcgttcaccatctctagagttccaaagccaaacaaagctttaaatcgaaaggcagggataggaaaagggaagccatgataacgcgatccagtttagcagatcaattaagagagtatcagcttcgatctaagcacgattgggcctctgtttcgtttttcgcatcaacctctaatctcacaacttctagagtggatgttgtggcctttgttatatgggaactcgttatattagcttttctggttttttcagccgtttctttatattttaggcatatgcaacttgcttttatcctagtatgcatcacattgttattgcttctgtgcatgaaaatcacaaagcaagtgagcttggctgggaaaaagaaaagaaggatgctgcttccattatctatgtaaaacacaaaatgataatgaatttgtctaaaaggagacagcttgttgtgtaattttgaaaattctcgatcattgcatctggcccatgctcaaaaaaaaaccccatagtggggattcctttcctttgttgcctttgccttgcctttcccttcactttttcttttattccttgtcatttcaactttaagaagaaattagttattagattagggtttcatttcttgtttaattctctctcaaactctccggtcaggtaattttctttttctttttagagaattgaaaaaaaagaagatatcagatatggcagaagaacatagatgtaaagcaccgccacaatgtacaaacaattgtagattcttcggaaacccagcaacccaaaatctttgttctcaatgttaccgccatctccagcaccttaaagaacaaggatcttcctctgctgccaaacaagcttttaatcaagccctcctcccttccttttcttcttcatcatcgtcgttttcggtttccttggcggtgaagcatgaaccgttggcggaaaccaaggaagaggtggtccaagcggaggttcaggtccacgttcaagttcgacctaacagatgcatgacttgcaagaagcgcgtggggctgacggggttcaagtgcaggtgtgggatggtgttttgtggcacccataggtaccctgaaaatcatggttgtagtttcgatttcaaagggatgggaaaacaacagattgccaaatcgaatccggttgtcaaaggcgagaagcttcagaaaatctaaaggaaaaaggggattgtttgtgattgtgttatggatggtctcgccggccgttggtgcttgtaatatgacatacattcaaatggtattttaatcttaatgcgggtgctgatttccaattggtttgttggttgcttttgcaaggaattattccaataatgaaagaaaactgctccctaataattcatactacattcttaatcattgttgttccaagttcttttatttattaagttgattttaacgg

SEQ ID NO: 701 - protein, 160 aa, Gossypium hirsutum
  misc_feature (1)..(160): Ceres Clone ID no. 1842119
  misc_feature (101)..(139): Pfam Name: zf-AN1 Pfam Description: AN1-like Zinc finger
  misc_feature (10)..(34): Pfam Name: zf-A20 Pfam Description: A20-like zinc finger
  misc_feature (1)..(160): Bit score of 281.0 for HMM based on sequences of Figure 3
  misc_feature (1)..(160): Functional Homolog Of SEQ ID NO. 451
MAEEHRCKAPPQCTNNCRFFGNPATQNLCSQCYRHLQHLKEQGSSSAAKQAFNQALLPSFSSSSSSFSVSLAVKHEPLAETKEEVVQAEVQVHVQVRPNRCMTCKKRVGLTGFKCRCGMVFCGTHRYPENHGCSFDFKGMGKQQIAKSNPVVKGEKLQKI

SEQ ID NO: 702 - protein, 172 aa, Solanum lycopersicum
  misc_feature (1)..(172): Public GI ID no. 222822659
  misc_feature (113)..(152): Pfam Name: zf-AN1 Pfam Description: AN1-like Zinc finger
  misc_feature (15)..(39): Pfam Name: zf-A20 Pfam Description: A20-like zinc finger
  misc_feature (1)..(172): Bit score of 318.6 for HMM based on sequences of Figure 3
  misc_feature (1)..(172): Functional Homolog Of SEQ ID NO. 451
MESSKETGCQAPEGPILCINNCGFFGSAATMNMCSKCHKDMILKQEQAKFAATSIENIVNGNSSSNGKEPIATGAINVQPGSADLKVISTEASSDLSSGPSSEVKPKEGPTRCTTCRKRVGLTGFNCKCGNLFCAAHRYSDKHECPFDYKNAGRDAIAKANPVVVAEKLNKI

SEQ ID NO: 703 - protein, 151 aa, Solanum pennellii
  misc_feature (1)..(151): Public GI ID no. 222822691
  misc_feature (92)..(130): Pfam Name: zf-AN1 Pfam Description: AN1-like Zinc finger
  misc_feature (16)..(39): Pfam Name: zf-A20 Pfam Description: A20-like zinc finger
  misc_feature (1)..(151): Bit score of 253.5 for HMM based on sequences of Figure 3
  misc_feature (1)..(151): Functional Homolog Of SEQ ID NO. 451
MAEEHEFQSQEGGRHQLCANNCGFFGNSTTENYCSKCYRDIEKQKSDAKSIDSLFSPTKKVSKKKIIEPIVLMTDTVNATTSNVVTPQSNRCLVCKKKMGLMGFKCRCGTIFCGTHRYPEVHACTFDFKSMGREAIAKANPLIKAEKLRKI

SEQ ID NO: 704 - protein, 172 aa, Ricinus communis
  misc_feature (1)..(172): Public GI ID no. 255544810
  misc_feature (113)..(152): Pfam Name: zf-AN1 Pfam Description: AN1-like Zinc finger
  misc_feature (15)..(39): Pfam Name: zf-A20 Pfam Description: A20-like zinc finger
  misc_feature (1)..(172): Bit score of 300.8 for HMM based on sequences of Figure 3
  misc_feature (1)..(172): Functional Homolog Of SEQ ID NO. 451
MDHDETGCQAPPERPILCINNCGFFGSAATMNMCSKCHKDMLMKQEQSKLTASSAGSILGGSSSSSLEQLIAAGTVNIQPNVEESKPIAVQPSYISELGESVEAKPKEGPNRCNACKKRVGLTGFKCRCGNLFCASHRYSDKHDCQFDYRNAAREAIAKANPIVRAEKLDKI

SEQ ID NO: 705 - protein, 177 aa, Arabidopsis lyrata
  misc_feature (1)..(177): Public GI ID no. 297847482
  misc_feature (1)..(177): Arabidopsis lyrata subsp. lyrata
  misc_feature (118)..(156): Pfam Name: zf-AN1 Pfam Description: AN1-like Zinc finger
  misc_feature (19)..(43): Pfam Name: zf-A20 Pfam Description: A20-like zinc finger
  misc_feature (1)..(177): Bit score of 285.3 for HMM based on sequences of Figure 3
  misc_feature (1)..(177): Functional Homolog Of SEQ ID NO. 451
MVLEMDHDKTGCQSPPEGPKLCINNCGFFGSAATMNMCSKCHKDMLFEQEQGAKFASAVSGTSSSSNLIKETITAALVDVETKSVEPMTVSVQPSSVQVVAEVVAPEEAAKPKGPSRCTTCNKRVGLTGFKCRCGNLFCGTHRYADIHDCSFNYHAAAQEAIAKANPVVKAEKLDKI

SEQ ID NO: 706 - protein, 170 aa, Picea sitchensis
  misc_feature (1)..(170): Public GI ID no. 116791002
  misc_feature (111)..(150): Pfam Name: zf-AN1 Pfam Description: AN1-like Zinc finger
  misc_feature (21)..(45): Pfam Name: zf-A20 Pfam Description: A20-like zinc finger
  misc_feature (1)..(170): Bit score of 293.0 for HMM based on sequences of Figure 3
  misc_feature (1)..(170): Functional Homolog Of SEQ ID NO. 451
MAQESWKNMGEDRGRQPPGGPVLCSNKCGFFGSSATMNMCSKCYRDHFLAQTQASAVKSAVEKSLSLDIDSSKALRFDASGVRNPAEVVGSSSDDGNSVSSEEPPRVSNRCQSCRKRVGLTGFKCRCGYVFCSLHRYSDKHGCSFDYKEAGRQEIEKANPVVKAEKIQKI

SEQ ID NO: 707 - protein, 174 aa, Arabidopsis lyrata
  misc_feature (1)..(174): Public GI ID no. 297809513
  misc_feature (1)..(174): Arabidopsis lyrata subsp. lyrata
  misc_feature (115)..(153): Pfam Name: zf-AN1 Pfam Description: AN1-like Zinc finger
  misc_feature (17)..(40): Pfam Name: zf-A20 Pfam Description: A20-like zinc finger
  misc_feature (1)..(174): Bit score of 222.1 for HMM based on sequences of Figure 3
  misc_feature (1)..(174): Functional Homolog Of SEQ ID NO. 451
MGSEQNNSTSFPPTEPKLCDNGCGFFGSPSNMNLCSKCYRSLRAEEDQTAVAKAAVKKSLKLPSCSIIAPGQKHPLEIKPAHLETVVVTAEPSSVPVATEQDEAEPSRPVRPNRCFSCNKKVGVMGFKCKCGSTFCGNHRYPEKHECSFDFKEVGRDAIAKANPLVKADKVQRI

SEQ ID NO: 708 - DNA, 674 bp, Gossypium hirsutum
  misc_feature (1)..(674): Ceres Clone ID no. 100049493
  misc_feature (1)..(674): Encodes the peptide sequence at SEQ ID NO. 709
catatttaatttgcaggcaattagaataacaaaaggcggcttcgctaggcttccatttttggcctttcaattaaaaaattattgattatttattgcttgctttttgtgtttttggttccctatccatcgttgcttcttcccttcccaccctttaagattattgcctctttacgctttatttcctttgttcacattcttccttccaccttttcctttcaagaaatttagcagatcgaaagattttttctttttttaaaaatggcggaggagcatagatgccaaacgccggaaggccaccgtctttgcgttaacaactgcggctttttcggaagtccggcgacaatgaatctttgctctaaatgttatagagatttccgtcttaaagaacaacagggagctacttccatcaaatcatctctttcttcctctccttcgttttcatcttcgtcagtcgttgtcgaatccgtttctcaggttccgctgttcaatctgcctgagttcattggagaatcgccagttcctgcagtggaggttgccctggtggctgagcaacggccgcaacagcaacaaccgaatcgatgcatggtttgcaggaaacgggtcgggttgaccgggttcaggtgcaaatgcgagattacattttgcgggtcccataggtatccagagaatcacgg

SEQ ID NO: 709 - protein, 138 aa, Gossypium hirsutum
  misc_feature (1)..(138): Ceres Clone ID no. 100049493
  misc_feature (14)..(37): Pfam Name: zf-A20 Pfam Description: A20-like zinc finger
  misc_feature (108)..(138): Pfam Name: zf-AN1 Pfam Description: AN1-like Zinc finger
  misc_feature (1)..(138): Bit score of 245.0 for HMM based on sequences of Figure 3
  misc_feature (1)..(138): Functional Homolog Of SEQ ID NO. 451
MAEEHRCQTPEGHRLCVNNCGFFGSPATMNLCSKCYRDFRLKEQQGATSIKSSLSSSPSFSSSSVVVESVSQVPLFNLPEFIGESPVPAVEVALVAEQRPQQQQPNRCMVCRKRVGLTGFRCKCEITFCGSHRYPENH

SEQ ID NO: 710 - protein, 172 aa, Solanum pennellii
  misc_feature (1)..(172): Public GI ID no. 222822685
  misc_feature (113)..(152): Pfam Name: zf-AN1 Pfam Description: AN1-like Zinc finger
  misc_feature (15)..(39): Pfam Name: zf-A20 Pfam Description: A20-like zinc finger
  misc_feature (1)..(172): Bit score of 310.0 for HMM based on sequences of Figure 3
  misc_feature (1)..(172): Functional Homolog Of SEQ ID NO. 451
MESSKETGCQAPEGPILCINNCGFFGSAATMNMCSKCHKDMILKQEQAKFAATSIENIVNGNSSSNGKEAIEIGAINVQPGSADLKVIYTEAYYDLSSGPSSEVKPKEGPTRCTTCRKRVGLTGFNCKCGNLFCAAHRYSDKHECPFDYKNAGRDAIAKANPVVVAEKLNKI

SEQ ID NO: 711 - protein, 168 aa, Brassica rapa
  misc_feature (1)..(168): Public GI ID no. 301133546
  misc_feature (109)..(148): Pfam Name: zf-AN1 Pfam Description: AN1-like Zinc finger
  misc_feature (15)..(39): Pfam Name: zf-A20 Pfam Description: A20-like zinc finger
  misc_feature (1)..(168): Bit score of 276.4 for HMM based on sequences of Figure 3
  misc_feature (1)..(168): Functional Homolog Of SEQ ID NO. 451
MDHDKTGCQSPPEGPKLCINNCGFFGSAATMNMCSKCHKTILFQQEHGAKLASAVSGSPSNILKETFTAALVDAGTKSIEPVAVSVQAVAEVVAPGESAAKPKEGPSRCTTCNKRVGLTGFKCRCGDLFCGTHRYADVHNCSFDYHTAAQEAIAKANPVVKADKLDKI

SEQ ID NO: 712 - protein, 172 aa, Vitis vinifera
  misc_feature (1)..(172): Public GI ID no. 225426659
  misc_feature (18)..(42): Pfam Name: zf-A20 Pfam Description: A20-like zinc finger
  misc_feature (113)..(152): Pfam Name: zf-AN1 Pfam Description: AN1-like Zinc finger
  misc_feature (1)..(172): Bit score of 257.2 for HMM based on sequences of Figure 3
  misc_feature (1)..(172): Functional Homolog Of SEQ ID NO. 451
MGSENKTNDETSFQPSEPILCANGCGFFGAAATMNLCSKCYRDLRIKEEQQASAKAAMNMSFNPKLLQENRTSSFSFLDTAGGSSSSSSCSFTFGNVGVGGGDKSEPKVPNRCMSCNKKVGLTGFRCKCGSTFCGAHRYPEKHECTFDFKASGRDAIAKANPVVKADKLDRL

SEQ ID NO: 713 - protein, 178 aa, Arabidopsis lyrata
  misc_feature (1)..(178): Public GI ID no. 297799728
  misc_feature (1)..(178): Arabidopsis lyrata subsp. lyrata
  misc_feature (119)..(157): Pfam Name: zf-AN1 Pfam Description: AN1-like Zinc finger
  misc_feature (19)..(43): Pfam Name: zf-A20 Pfam Description: A20-like zinc finger
  misc_feature (1)..(178): Bit score of 200.6 for HMM based on sequences of Figure 3
  misc_feature (1)..(178): Functional Homolog Of SEQ ID NO. 451
MGSEQNDSTSFTQSQASEPKLCAKGCGFFGSPSNMDLCSKCYRSICAEEAQTAVVKAAVEKSFKPSPLPLPSRSLFIAEPAVVKPEPEKAVVVVSAEPSSATVPEEREPSRPARPTNRCLCCNKKVGIMGFKCKCGSTFCGDHRYPEIHDCSFDFKETGRGEIAKANPVVKADKLQRF

SEQ ID NO: 714 - protein, 175 aa, Arabidopsis thaliana
  misc_feature (1)..(175): Public GI ID no. 15234402
  misc_feature (116)..(154): Pfam Name: zf-AN1 Pfam Description: AN1-like Zinc finger
  misc_feature (17)..(40): Pfam Name: zf-A20 Pfam Description: A20-like zinc finger
  misc_feature (1)..(175): Bit score of 216.6 for HMM based on sequences of Figure 3
  misc_feature (1)..(175): Functional Homolog Of SEQ ID NO. 451
MGSEENNSTSFPPTEPKLCDNGCGFFGSPSNMNLCSKCYRSLRAEEDQTAVAKAAVKNSLKLPSCSIIAPGQKHPLEIKPAHLETVVVTAEPSSVPVAAEQDEAEPSRPVRPNNRCFSCNKKVGVMGFKCKCGSTFCGSHRYPEKHECSFDFKEVGRDAIAKANPLVKADKVQRI

SEQ ID NO: 715 - protein, 171 aa, Saccharum officinarum
  misc_feature (1)..(171): Public GI ID no. 254030287
  misc_feature (112)..(151): Pfam Name: zf-AN1 Pfam Description: AN1-like Zinc finger
  misc_feature (14)..(38): Pfam Name: zf-A20 Pfam Description: A20-like zinc finger
  misc_feature (1)..(171): Bit score of 358.4 for HMM based on sequences of Figure 3
  misc_feature (1)..(171): Functional Homolog Of SEQ ID NO. 451
MEHKETGCQAPEGPILCINNCGFFGSAATMNMCSKCHKEMIMKQEQAKLAASSIDSIVNGNDAVMEPVVSGNTVVAVAQVELQTMNVQPTDVAGPSEGAAVISKGKVGPNRCSTCRKRVGLTGFNCRCGNLYCALHRYSDKHDCKFDYRTAARDAIAKANPVVKADKLDKI

SEQ ID NO: 716 - protein, 175 aa, Arabidopsis thaliana
  misc_feature (1)..(175): Public GI ID no. 222423788
  misc_feature (116)..(154): Pfam Name: zf-AN1 Pfam Description: AN1-like Zinc finger
  misc_feature (17)..(40): Pfam Name: zf-A20 Pfam Description: A20-like zinc finger
  misc_feature (1)..(175): Bit score of 209.8 for HMM based on sequences of Figure 3
  misc_feature (1)..(175): Functional Homolog Of SEQ ID NO. 451
MGSEENNSTSFPPTEPKLCDNGCGFFGPPSNMNLCSKCYRSLRAEEDQTAVAKAAVKNSLKLPSCSIIAPGQKHPLEIKPAHLETVVVTAEPSSVPVAAEQDEAEPSRPVRPNNRCFSCNKKVGVMGFKCKCGSTFCGSHRYPEKHECSFDFKEVGRDAIAKANPLVKADKVQRI

SEQ ID NO: 717 - protein, 170 aa, Solanum pennellii
  misc_feature (1)..(170): Public GI ID no. 222822679
  misc_feature (111)..(150): Pfam Name: zf-AN1 Pfam Description: AN1-like Zinc finger
  misc_feature (15)..(39): Pfam Name: zf-A20 Pfam Description: A20-like zinc finger
  misc_feature (1)..(170): Bit score of 308.1 for HMM based on sequences of Figure 3
  misc_feature (1)..(170): Functional Homolog Of SEQ ID NO. 451
MEHDETGCQPHPEGPILCINNCGFFGSAANMNMCSKCYKDVILKQEQEKLAASSIENFVNGSTSQKGPVIVGSVDVQPALLESKSVVLSSPPSSSSGEVAELMAKEGPSRCSTCKKKVGLTGFKCRCGNFYCGSHRYSDKHDCQFDYRSAARNAIAKANPVVKAGKLDKI

SEQ ID NO: 718 - protein, 170 aa, Solanum lycopersicum
  misc_feature (1)..(170): Public GI ID no. 222822653
  misc_feature (111)..(150): Pfam Name: zf-AN1 Pfam Description: AN1-like Zinc finger
  misc_feature (15)..(39): Pfam Name: zf-A20 Pfam Description: A20-like zinc finger
  misc_feature (1)..(170): Bit score of 308.7 for HMM based on sequences of Figure 3
  misc_feature (1)..(170): Functional Homolog Of SEQ ID NO. 451
MEHDETGCQPHPEGPILCINNCGFFGSAANMNMCSKCYKDVILKQEQEKLAASSIENFVNGSTSQKGPVIVGSVDVQPALLESKSVVLSSPPSSSSGEAAELMAKEGPSRCSTCKKKVGLTGFKCRCGNFYCGSHRYSDKHDCQFDYRSAARNAIAKANPVVKAEKLDKI

SEQ ID NO: 719 - protein, 175 aa, Selaginella moellendorffii
  misc_feature (1)..(175): Public GI ID no. 302787300
  misc_feature (21)..(45): Pfam Name: zf-A20 Pfam Description: A20-like zinc finger
  misc_feature (116)..(155): Pfam Name: zf-AN1 Pfam Description: AN1-like Zinc finger
  misc_feature (1)..(175): Bit score of 285.7 for HMM based on sequences of Figure 3
  misc_feature (1)..(175): Functional Homolog Of SEQ ID NO. 451
MAQESWKREEEAAGCQLPEGPVLCANNCGFFGSVATMNLCSKCYREQSSSKAAAETMITTTTTAAAAAATPAAKEEALAAIATSRTSTTIATAATTLVTEDDSSASQEKPRLSNRCLACRKRLGLTGFKCRCGDVFCSMHRYSDKHNCSFDYKAAGREAIAKANPVVKADKIEKI

SEQ ID NO: 720 - DNA, 1067 bp, Panicum virgatum
  misc_feature (1)..(1067): Ceres Clone ID no. 1955772
  misc_feature (1)..(1067): Encodes the peptide sequence at SEQ ID NO. 721
actctcgacgctcgacccggaaaaaaaaattattctccgcgggggggaaggggaaaggtcgcgtggcgtctcggtctcgcccacagtccatcggtagcaatggcacaagagagctggaaacaagagaccgaggcgactggagtccacgcgcctgagacccctattctctgcataaacaactgtggtttctttggcagcagcatgaagaacaatatgtgttcgaagtgctacagggacttcatcaagttgatggaagcccctgtggtggagaagaaggtgatcacgtcagcatcttcttccgcggcaccactggagacaatgcgagatgatgcgcctacagctgctgccactgaagctgtgactgagaagcaagcagagcaagagcccccaaagccgcccagcaaccggtgcctgacctgccgcaagaaggtcggactgaccggcttcctttgccgctgtgggggcacattctgctccacgcaccgctacaccgactcccaccagtgcacctttgactacaagaaggtggcacgggagcagatagccaagcagaatccagttgtgatggccgagaagataaacaagatctgatgcatgcccgtgaagggattgctgagttcatgcctgggtttcgagtcctcaagttcactacaatcgataggttccttcgggtggtggtctgggttagcgtggtagtaggggatctcaattgtgtctatccttctccgttatcatggttctattctctgccggaatgatgcagtggttttgcgtcgtcacttcctcaggaagtagtttaagtcgagaagataagattgcacatcaggtattgcttattctggtcctggacggctaagtgttgtatcgacatgtcattggttttgtatcgctgtatgttatcacttgtgctggaagtcgcagcaggtatgaagcttatctgatcctgctaccatcatgtttatgtgatcagatgaagttatagataagcatatacatatcaaatctgtttatttgtgatgttggtcgtaaggtttgcaaataataagatgcagagcttttgatgaatc

SEQ ID NO: 721 - protein, 163 aa, Panicum virgatum
  misc_feature (1)..(163): Ceres Clone ID no. 1955772
  misc_feature (104)..(142): Pfam Name: zf-AN1 Pfam Description: AN1-like Zinc finger
  misc_feature (21)..(45): Pfam Name: zf-A20 Pfam Description: A20-like zinc finger
  misc_feature (1)..(163): Bit score of 351.3 for HMM based on sequences of Figure 3
  misc_feature (1)..(163): Functional Homolog Of SEQ ID NO. 451
MAQESWKQETEATGVHAPETPILCINNCGFFGSSMKNNMCSKCYRDFIKLMEAPVVEKKVITSASSSAAPLETMRDDAPTAAATEAVTEKQAEQEPPKPPSNRCLTCRKKVGLTGFLCRCGGTFCSTHRYTDSHQCTFDYKKVAREQIAKQNPVVMAEKINKI

SEQ ID NO: 722 - protein, 171 aa, Solanum lycopersicum
  misc_feature (1)..(171): Public GI ID no. 222822655
  misc_feature (15)..(39): Pfam Name: zf-A20 Pfam Description: A20-like zinc finger
  misc_feature (112)..(150): Pfam Name: zf-AN1 Pfam Description: AN1-like Zinc finger
  misc_feature (1)..(171): Bit score of 307.9 for HMM based on sequences of Figure 3
  misc_feature (1)..(171): Functional Homolog Of SEQ ID NO. 451
MEHNETGCQPPREGPILCINNCGFFGSAANMNMCSKCYKDMVLKQEQAKLAVSSIENLVNGSSASEKGMVIAGPVDVQPDTIEAQSIALPSSQTSSSSDMPDVKAKVGPNRCGTCKKKVGITGFKCRCGNLYCGAHRYSDKHDCLFDYRSAGQDAIAKANPVVKAEKLDKI

SEQ ID NO: 723 - protein, 172 aa, Vitis vinifera
  misc_feature (1)..(172): Public GI ID no. 225435496
  misc_feature (113)..(152): Pfam Name: zf-AN1 Pfam Description: AN1-like Zinc finger
  misc_feature (15)..(39): Pfam Name: zf-A20 Pfam Description: A20-like zinc finger
  misc_feature (1)..(172): Bit score of 328.8 for HMM based on sequences of Figure 3
  misc_feature (1)..(172): Functional Homolog Of SEQ ID NO. 451
MDHDETGCQAHPEGPILCINNCGFFGSPATMNMCSKCHKDMMLKQEQAKLAASSIDSIVNGSSSNNGKEPAIASTVDVQVDAKEPKIISVQSSFSFGSEGSGEAKPKEGPNRCSTCKKRVGLTGFNCRCGHLFCATHRYSDKHDCPFDYRTAARDAIAKANPVVKAEKLDKI

SEQ ID NO: 724 - protein, 176 aa, Arabidopsis thaliana
  misc_feature (1)..(176): Public GI ID no. 15235819
  misc_feature (117)..(155): Pfam Name: zf-AN1 Pfam Description: AN1-like Zinc finger
  misc_feature (19)..(43): Pfam Name: zf-A20 Pfam Description: A20-like zinc finger
  misc_feature (1)..(176): Bit score of 209.8 for HMM based on sequences of Figure 3
  misc_feature (1)..(176): Functional Homolog Of SEQ ID NO. 451
MGSEQNDSTSFTQSQASEPKLCVKGCGFFGSPSNMDLCSKCYRGICAEEAQTAVAKAAVEKSFKPSPPRSLFIAEPPAVVVEPKPEKAAVVVVSAEPSSSAVPEANEPSRPARTNRCLCCNKKVGIMGFKCKCGSTFCGEHRYPETHDCSFDFKEVGRGEIAKANPVVKADKIQRF

SEQ ID NO: 725 - protein, 171 aa, Zea mays
  misc_feature (1)..(171): Public GI ID no. 212275744
  misc_feature (112)..(151): Pfam Name: zf-AN1 Pfam Description: AN1-like Zinc finger
  misc_feature (14)..(38): Pfam Name: zf-A20 Pfam Description: A20-like zinc finger
  misc_feature (1)..(171): Bit score of 329.1 for HMM based on sequences of Figure 3
  misc_feature (1)..(171): Functional Homolog Of SEQ ID NO. 451
MEHKEAGCQQPEGPILCINNCGFFGSAATMNMCSKCHKEMITKQEQAQLAASSIDSIVNGGDGGKGPVIAASVNVAVPQVEQKTIVVQPMLVAETSEAAAVIPKAKEGPDRCAACRKRVGLTGFSCRCGNMYCSVHRYSDKHDCQFDYRTAARDAIAKANPVVRAEKLDKI

SEQ ID NO: 726 - protein, 162 aa, Picea sitchensis
  misc_feature (1)..(162): Public GI ID no. 116787141
  misc_feature (103)..(142): Pfam Name: zf-AN1 Pfam Description: AN1-like Zinc finger
  misc_feature (21)..(45): Pfam Name: zf-A20 Pfam Description: A20-like zinc finger
  misc_feature (1)..(162): Bit score of 258.9 for HMM based on sequences of Figure 3
  misc_feature (1)..(162): Functional Homolog Of SEQ ID NO. 451
MAQDNWKGDSEGTGYQPQEDPILCANSCGFFGSSSTMNFCSKCFKDLVLKQALSAAVVEISSGSALGLQQPVQIADQLARPATLEQGEGTSSGEQPKPPANRCTYCKKRVGLTGFKCRCGDTFCSLHRYSETHDCLFDYRKAGRETIRKENPVVKAEKIDKI

SEQ ID NO: 727 - protein, 172 aa, Moniliophthora perniciosa
  misc_feature (1)..(172): Public GI ID no. 238575930
  misc_feature (1)..(172): Moniliophthora perniciosa FA553
  misc_feature (113)..(152): Pfam Name: zf-AN1 Pfam Description: AN1-like Zinc finger
  misc_feature (15)..(39): Pfam Name: zf-A20 Pfam Description: A20-like zinc finger
  misc_feature (1)..(172): Bit score of 288.2 for HMM based on sequences of Figure 3
  misc_feature (1)..(172): Functional Homolog Of SEQ ID NO. 451
MESHDETGCQAPKGPILCINNCGFFGSAATANMCSKCHKDVILKQEQAQAAASSIESIVNRSSNENGKGPVATEKLDLQAGLVDAKVISTEPSAGSSSSKDVDMKVSDGPKRCTTCQRRVGLTGFNCKCGNLFCSTHRYSDIHGCPFDYRTAARDAIAKANPVVRADKLDKI

SEQ ID NO: 728 - protein, 169 aa, Hordeum vulgare
  misc_feature (1)..(169): Public GI ID no. 326515250
  misc_feature (1)..(169): Hordeum vulgare subsp. vulgare
  misc_feature (14)..(38): Pfam Name: zf-A20 Pfam Description: A20-like zinc finger
  misc_feature (110)..(148): Pfam Name: zf-AN1 Pfam Description: AN1-like Zinc finger
  misc_feature (1)..(169): Bit score of 317.0 for HMM based on sequences of Figure 3
  misc_feature (1)..(169): Functional Homolog Of SEQ ID NO. 451
MEHKETGCQSREGPILCVNNCGFFGSAATMNMCSKCHKEMAMKQEQAKLAASSFDSIVNGGDAVKEHLAAGSTAVAVAHVQAKALITAQPADIAGPSEAAMESPKGPSRCSTCRKRVGLTGFNCRCGNLYCATHRYSDKHECKFDYRAAAMDAIAKANPVVKAEKLDKI

SEQ ID NO: 729 - protein, 172 aa, Medicago truncatula
  misc_feature (1)..(172): Public GI ID no. 217075260
  misc_feature (113)..(152): Pfam Name: zf-AN1 Pfam Description: AN1-like Zinc finger
  misc_feature (15)..(39): Pfam Name: zf-A20 Pfam Description: A20-like zinc finger
  misc_feature (1)..(172): Bit score of 270.2 for HMM based on sequences of Figure 3
  misc_feature (1)..(172): Functional Homolog Of SEQ ID NO. 451
MESHDEMGCQAPERPILCVNNCGFFGREATMNKCSKCYKDTLLKQEQEKLVATSVENIVNGNSSSNGKLAVTASAVDVRVESVELNTVSPEVPENPISNESVEMKAKTGPSRCATCRKRVGLTGFSCKCGNLFCSMHRYSDKHDCPFDYRTAGQKAIAESNPVIKADKLDKI

SEQ ID NO: 730 - protein, 181 aa, Oryza sativa
  misc_feature (1)..(181): Public GI ID no. 222622367
  misc_feature (1)..(181): Oryza sativa Japonica Group
  misc_feature (122)..(161): Pfam Name: zf-AN1 Pfam Description: AN1-like Zinc finger
  misc_feature (22)..(46): Pfam Name: zf-A20 Pfam Description: A20-like zinc finger
  misc_feature (1)..(181): Bit score of 343.9 for HMM based on sequences of Figure 3
  misc_feature (1)..(181): Functional Homolog Of SEQ ID NO. 451
MEVQITVAMEHKEAGCQQPEGPILCINNCGFFGSAATMNMCSKCHKEMIMKEEQAKLAASSIDSIVNGCDGGKEHIVAASGSTAVAVAQVEAKTLVVQPTDVAGTSEEVAVVPKVKEGPNRCATCRKRVGLTGFNCRCGNMYCALHRYSDKHECQFDYRTAARDAIAKANPVVKAEKLDKI

SEQ ID NO: 731 - protein, 171 aa, Solanum pennellii
  misc_feature (1)..(171): Public GI ID no. 222822681
  misc_feature (15)..(39): Pfam Name: zf-A20 Pfam Description: A20-like zinc finger
  misc_feature (112)..(150): Pfam Name: zf-AN1 Pfam Description: AN1-like Zinc finger
  misc_feature (1)..(171): Bit score of 297.6 for HMM based on sequences of Figure 3
  misc_feature (1)..(171): Functional Homolog Of SEQ ID NO. 451
MEHIETGCQPLREGPILCINNCGFFGSAANMNMCSKCYKDMVLKQEQAKLDVSSIENLVNGSSASEKGMVIAGPVDVQPDTIEAQSIALPSSQTSSSSDMPDVKAKVGPNRCGTCKKKVGITGFKCRCGNLYCGAHRYSDKHDCLFDYRSAGQDAIAKANPVVKAEKLDKI

SEQ ID NO: 732 - protein, 174 aa, Zea mays
  misc_feature (1)..(174): Public GI ID no. 194692334
  misc_feature (115)..(154): Pfam Name: zf-AN1 Pfam Description: AN1-like Zinc finger
  misc_feature (14)..(38): Pfam Name: zf-A20 Pfam Description: A20-like zinc finger
  misc_feature (1)..(174): Bit score of 342.1 for HMM based on sequences of Figure 3
  misc_feature (1)..(174): Functional Homolog Of SEQ ID NO. 451
MEHKEAGCQAPEGPILCINNCGFFGSAATMNMCSKCHKEMITKQDQAKLAASSIDSIVNGSDAVMEPVVAGSNTVVAVAQVELQTMNVQQPADVAGSSEGVAAISKGGKVGPNRCSACRKRVGLTGFNCRCGNLYCALHRYSDKHDCKFDYRTAARDAIAKANPVVKADKLDKI

SEQ ID NO: 733 - protein, 180 aa, Picea sitchensis
  misc_feature (1)..(180): Public GI ID no. 116791662
  misc_feature (121)..(160): Pfam Name: zf-AN1 Pfam Description: AN1-like Zinc finger
  misc_feature (22)..(45): Pfam Name: zf-A20 Pfam Description: A20-like zinc finger
  misc_feature (1)..(180): Bit score of 263.6 for HMM based on sequences of Figure 3
  misc_feature (1)..(180): Functional Homolog Of SEQ ID NO. 451
MAQESWNREKEETGCQVPEGLIRCANNCGFFGSPATMSLCSKCYREFVLLNSPKSSFDKPQQQQIQGEVSIPRPDVGDEEIRSKYLAVDGSGPSCSTAAHQLEPQQQQNPPPPPPRQTNRCFSCRKRVGLTGFRCRCGDMFCALHRYSDKHKCTYDYKTAGREAIAKANPLVKADKILRF

SEQ ID NO: 734 - protein, 172 aa, Physcomitrella patens
  misc_feature (1)..(172): Public GI ID no. 168007673
  misc_feature (1)..(172): Physcomitrella patens subsp. patens
  misc_feature (21)..(45): Pfam Name: zf-A20 Pfam Description: A20-like zinc finger
  misc_feature (113)..(152): Pfam Name: zf-AN1 Pfam Description: AN1-like Zinc finger
  misc_feature (1)..(172): Bit score of 265.2 for HMM based on sequences of Figure 3
  misc_feature (1)..(172): Functional Homolog Of SEQ ID NO. 451
MAQYGRKQDTEETNCQPPEGPVRCTNNCGFFGSAVTMGMCSKCYRDFVLTQAKTSSAKIAETTPIVSVPKEPVADRALFQSSHFLSAQPEAAGASSGASASGQDPSRPKANRCFSCKKRVGLTGFECRCGNLFCSAHRYSDKHSCTFDYKTAGRDAISKANPVVKADKMNKI

SEQ ID NO: 735 - protein, 165 aa, Solanum pennellii
  misc_feature (1)..(165): Public GI ID no. 222822687
  misc_feature (19)..(43): Pfam Name: zf-A20 Pfam Description: A20-like zinc finger
  misc_feature (106)..(145): Pfam Name: zf-AN1 Pfam Description: AN1-like Zinc finger
  misc_feature (1)..(165): Bit score of 225.2 for HMM based on sequences of Figure 3
  misc_feature (1)..(165): Functional Homolog Of SEQ ID NO. 451
MGFEGNKFNDGTSFQPADPILCSNGCGFFGTAATKGLCSKCYRDFKMKEDHAAMAKVAMEKLVISRPQIESIGKVDFCSSTTSTVTERPVVEAATAEIGGSQPNRCFSCRKKVGFVGFKCRCGSTFCGTHRYPEKHDCTFDFKVKGKEEICKANPVVKADKIQRF

SEQ ID NO: 736 - protein, 176 aa, Hordeum vulgare
  misc_feature (1)..(176): Public GI ID no. 326499404
  misc_feature (1)..(176): Hordeum vulgare subsp. vulgare
  misc_feature (117)..(156): Pfam Name: zf-AN1 Pfam Description: AN1-like Zinc finger
  misc_feature (14)..(38): Pfam Name: zf-A20 Pfam Description: A20-like zinc finger
  misc_feature (1)..(176): Bit score of 349.3 for HMM based on sequences of Figure 3
  misc_feature (1)..(176): Functional Homolog Of SEQ ID NO. 451
MEHKEAGCQQPEGPILCVNNCGFFGSAATMNMCSKCHKEMVMKEEQAKLAASSFDSIVNGGDGGKAPVVVAAVAASAEVAVAQVDVKALVVQPAADVAGTSEAVAVSPKRKEGPNRCSTCRKRVGLTGFNCRCGNMYCSLHRYSDKHDCQFDYRTAARDAIAKANPVVKAEKLDKI

SEQ ID NO: 737 - protein, 176 aa, Glycine max
  misc_feature (1)..(176): Public GI ID no. 255628951
  misc_feature (117)..(156): Pfam Name: zf-AN1 Pfam Description: AN1-like Zinc finger
  misc_feature (15)..(39): Pfam Name: zf-A20 Pfam Description: A20-like zinc finger
  misc_feature (1)..(176): Bit score of 309.0 for HMM based on sequences of Figure 3
  misc_feature (1)..(176): Functional Homolog Of SEQ ID NO. 451
MDHDKTGCQAPPEGPILCINNCGFFGSAATMNMCSKCHKDMLLKQEQAKLAASSIGNIMNGSSSSTEKEPVVVAAAAANVDIPVIPVEPKTVSVQPLFGSGPEGSGEAKLKDGPKRCSSCNKRVGLTGFNCRCGDLFCAVHRYSDKHNCPFDYRTAARDAIAKANPVVKAEKLDKI

SEQ ID NO: 738 - protein, 160 aa, Hordeum vulgare
  misc_feature (1)..(160): Public GI ID no. 326496248
  misc_feature (1)..(160): Hordeum vulgare subsp. vulgare
  misc_feature (19)..(43): Pfam Name: zf-A20 Pfam Description: A20-like zinc finger
  misc_feature (101)..(140): Pfam Name: zf-AN1 Pfam Description: AN1-like Zinc finger
  misc_feature (1)..(160): Bit score of 304.0 for HMM based on sequences of Figure 3
  misc_feature (1)..(160): Functional Homolog Of SEQ ID NO. 451
MTQDSWKESEETVQTPEAPILCVNNCGFFGSSMTNNMCSKCYRDFIKATTIAAPVAEKKVFTVASSSNVTLEQAKADEVGAVPLVDSQAAQEPPKPPSNRCLSCRKKVGLTGFQCRCGGTFCSMHRYADSHECSFDYKKAGREQIAKQNPVVIGEKINKI

SEQ ID NO: 739 - protein, 169 aa, Arabidopsis lyrata
  misc_feature (1)..(169): Public GI ID no. 297849616
  misc_feature (1)..(169): Arabidopsis lyrata subsp. lyrata
  misc_feature (110)..(147): Pfam Name: zf-AN1 Pfam Description: AN1-like Zinc finger
  misc_feature (16)..(40): Pfam Name: zf-A20 Pfam Description: A20-like zinc finger
  misc_feature (1)..(169): Bit score of 230.2 for HMM based on sequences of Figure 3
  misc_feature (1)..(169): Functional Homolog Of SEQ ID NO. 451
MGSEQNDGTSFSPSEPKLCVKGCGFFGSPSNMNLCSKCYRDIRATEEQTASAKAAVEKSLNPNKPKIQPQQSQEITQGVLESGSSSSSTTSGGDLAAAPLDPPKSTATRCLSCNKKVGVTGFKCKCGSTFCGTHRYPETHECEFDFKGVAREAIAKANPVVKADKVERI

SEQ ID NO: 740 - protein, 161 aa, Hordeum vulgare
  misc_feature (1)..(161): Public GI ID no. 326489039
  misc_feature (1)..(161): Hordeum vulgare subsp. vulgare
  misc_feature (20)..(44): Pfam Name: zf-A20 Pfam Description: A20-like zinc finger
  misc_feature (102)..(141): Pfam Name: zf-AN1 Pfam Description: AN1-like Zinc finger
  misc_feature (1)..(161): Bit score of 277.5 for HMM based on sequences of Figure 3
  misc_feature (1)..(161): Functional Homolog Of SEQ ID NO. 451
MAQESWKEAEDTGVHAPEAPILCVNNCGFFGNRMTENMCSKCYRDTAKAKRMATLVENKTAAAVASSPTPLVAEMKDEASGSAKEGKQVAEEEAPKPPSNRCLSCRKKVGLTGFKCRCGDTFCSMHRYADAHDCKFDYKQAGREQIAQQNPVVKADKVTRF

SEQ ID NO: 741 - DNA, 741 bp, Sorghum bicolor
  misc_feature (1)..(741): Ceres Annot ID no. 8672029
  misc_feature (1)..(741): Encodes the peptide sequence at SEQ ID NO. 742
atggttcatagacaaaagaagagctcccctttctctacttttttctcaattaagaaaaatccctctctcaacatctcaaataaaagggagagcaactcccattctatcatgttggtgagcagatcaccacgtcgttcctctaggcacaccaagccggagggcccaatcctatgcatcaataactgcggtttctttggcagcgctgccaccatgaacatgtgctccaagtgccacaaggagatgataatgaagcaggagcaggcccagctggctgcctcctccattgatagcattgtcaatggtggtgatggtgggaaagggcctgtaattgccgcaactgtagatgcggcagttcctcaagttgaggagaagactattgttgtgcagcctatgcatgtagctgaaaccagcgaggctgctgctgtaatccccaaggccaaggaaggcccaaacaggtgtgcaacctgtaggaagcgtgttgggttgacaggatttaactgccgatgcgggaacatgtactgttcggtgcaccgctactccgacaaacatgactgccagttcgactatcgaactgcagctagggacgcgattgccaaggccaatcctgtggtgaaggcggagaactgcaagaattcgtccccagtcgagtccaaaatggtttgcgtgttggctatgtcgtgtaagcttattcagttattcatggtggtttcggtcggtattgtggcattcccatttaggtag

SEQ ID NO: 742 - protein, 246 aa, Sorghum bicolor
  misc_feature (1)..(246): Ceres Annot ID no. 8672029
  misc_feature (153)..(192): Pfam Name: zf-AN1 Pfam Description: AN1-like Zinc finger
  misc_feature (55)..(79): Pfam Name: zf-A20 Pfam Description: A20-like zinc finger
  misc_feature (1)..(246): Bit score of 290.8 for HMM based on sequences of Figure 3
  misc_feature (1)..(246): Functional Homolog Of SEQ ID NO. 451
MVHRQKKSSPFSTFFSIKKNPSLNISNKRESNSHSIMLVSRSPRRSSRHTKPEGPILCINNCGFFGSAATMNMCSKCHKEMIMKQEQAQLAASSIDSIVNGGDGGKGPVIAATVDAAVPQVEEKTIVVQPMHVAETSEAAAVIPKAKEGPNRCATCRKRVGLTGFNCRCGNMYCSVHRYSDKHDCQFDYRTAARDAIAKANPVVKAENCKNSSPVESKMVCVLAMSCKLIQLFMVVSVGIVAFPFR

SEQ ID NO: 743 - DNA, 931 bp, Arabidopsis thaliana
  misc_feature (1)..(931): Ceres Clone ID no. 24253
  misc_feature (1)..(931): Encodes the peptide sequence at SEQ ID NO. 744
  misc_feature (338)..(338): r is g or a
tggttttctgttctgtcctaatttctctctggcgaaagctaagaggtttcggttacggtctccatctccgatcaaatcacgaagtttctatcggaaattttcagtgatacataccgtcagagattttctttacgagagaattgtcgccgacatactaaagcagagttttgggtgggaattagtaagatttcgactttagaattgggagatctttccattatgggttctgagcaaaacgacagcacaagcttctctccttcagagccaaagctctgcgtcaaaggatgtggcttcttcggatctccatcgaacatgaacctctgctctaaatgctacaragacatccgagccacggaggaacaaaccgcttccgctaaagccgccgtcgagaaatctctaaaccctaataaacccaaaactcaaccacaacagagccaagaaatcactcaaggcgtcctcggatctggatcgtcttcctcatcaacgagagggggtgattcggctgctgctccgttggatccaccgaaatcgacggctacgagatgcttgagctgtaacaagaaagttggcgtgacgggtttcaagtgtaggtgtggaagcactttctgtggaactcatagatatccagagagtcacgagtgccaattcgatttcaaaggagttgcgagagaagctattgctaaagctaatcctgtggtgaaggctgataaggttgataggatatgaattggtgaagaaactgttgtgttctcttttgtttttttattttcaagtctcgtgatgttggtggtttggctctctgttttctgctcttattatggttttatttgcttttagggtttcttaggaaaggccttagattctgctattatgtggtttcatgttttgcaacattggatttgttgttctgtaataaagtgttggttatatt

SEQ ID NO: 744 - protein, 168 aa, Arabidopsis thaliana
  misc_feature (1)..(168): Ceres Clone ID no. 24253
  misc_feature (109)..(146): Pfam Name: zf-AN1 Pfam Description: AN1-like Zinc finger
  misc_feature (16)..(39): Pfam Name: zf-A20 Pfam Description: A20-like zinc finger
  misc_feature (1)..(168): Bit score of 236.7 for HMM based on sequences of Figure 3
  misc_feature (1)..(168): Bit score of 231.8 for HMM based on sequences of Figure 3
  misc_feature (1)..(168): Functional Homolog Of SEQ ID NO. 451
  misc_feature (40)..(40): Xaa is any aa, unknown or other
MGSEQNDSTSFSPSEPKLCVKGCGFFGSPSNMNLCSKCYXDIRATEEQTASAKAAVEKSLNPNKPKTQPQQSQEITQGVLGSGSSSSSTRGGDSAAAPLDPPKSTATRCLSCNKKVGVTGFKCRCGSTFCGTHRYPESHECQFDFKGVAREAIAKANPVVKADKVDRI

SEQ ID NO: 745 - protein, 136 aa, Vitis vinifera
  misc_feature (1)..(136): Public GI ID no. 297739707
  misc_feature (77)..(116): Pfam Name: zf-AN1 Pfam Description: AN1-like Zinc finger
  misc_feature (15)..(39): Pfam Name: zf-A20 Pfam Description: A20-like zinc finger
  misc_feature (1)..(136): Bit score of 286.5 for HMM based on sequences of Figure 3
  misc_feature (1)..(136): Functional Homolog Of SEQ ID NO. 451
MESHDETGCQAPEGPILCINNCGFFGSAATMNMCSKCHKDLALKQEQAKLAASSIGSIVNGSSSGNGKEPIEGPNRCTACRKRVGLTGFNCKCGNLFCAVHRYSDKHDCPFDYRTAARDAIAKANPVVKAEKLDKI

SEQ ID NO: 746 - protein, 164 aa, Medicago truncatula
  misc_feature (1)..(164): Public GI ID no. 217075452
  misc_feature (113)..(152): Pfam Name: zf-AN1 Pfam Description: AN1-like Zinc finger
  misc_feature (15)..(39): Pfam Name: zf-A20 Pfam Description: A20-like zinc finger
  misc_feature (1)..(164): Bit score of 252.1 for HMM based on sequences of Figure 3
  misc_feature (1)..(164): Functional Homolog Of SEQ ID NO. 451
MDHDQTGCEAAPEGPMLCINNCGFFGSAATMNMCSKCHKDMMLKQEQATLAASSIGNIMNGSSSSSGIEPAITANVEISVDPVEPKIISAEPLVASGSEESLEKKPKDGPKRCSNCNKRVGLTGFNCRCGNLYCAVHRYSDKHDCPFDYRTAGRDAIAKANPCL

SEQ ID NO: 747 - protein, 188 aa, Physcomitrella patens
  misc_feature (1)..(188): Public GI ID no. 168037934
  misc_feature (1)..(188): Physcomitrella patens subsp. patens
  misc_feature (129)..(168): Pfam Name: zf-AN1 Pfam Description: AN1-like Zinc finger
  misc_feature (18)..(42): Pfam Name: zf-A20 Pfam Description: A20-like zinc finger
  misc_feature (1)..(188): Bit score of 228.7 for HMM based on sequences of Figure 3
  misc_feature (1)..(188): Functional Homolog Of SEQ ID NO. 451
MATERVTQETTSQTPEGPVMCKNVCGFFGSQATMGLCSKCYRETVMQAKMTAVAEQATQAAQVLPSAASSAQPPVLMEEDKSSFEADSMLIQPPQSSSHHPVEVAPVTVAPQVVVAPVATPSRPAPNRCGSCRKRVGLTGFQCRCGHLFCALHRYSDKHSCTYDYKAAGQEAIAKANPLVVAEKVVKF

SEQ ID NO: 748 - DNA, 498 bp, Glycine max
  misc_feature (1)..(498): Ceres Clone ID no. 682858
  misc_feature (1)..(498): Encodes the peptide sequence at SEQ ID NO. 749
attccatacctcaacaaaacaaggttcagagacttttccgattcctggaagaagagaagagaaaacctaaatcacagatccatggcggaagaacaccgatgtgaacctcccgaaggtcaccgactctgcgtcaacaactgcggcttcttcggtagcaccgccacgatgaacctctgctccaaatgctacagcgcgatccgtttgaaggagcaagaagaagcgtcgacgaaatccacaatcgaaaccgcgctctcttctgcctcctcggcgaaaccgtcgtcgtccacgtcacctccgccgtcggcggtcgatgtgctcatggaatctccaccgccgtctgcggcggaggttgaggttgctgtcacggtcacggtcgcggtggcgtcgagttctatttccataaactcaggttcggttgcgcaaccgaaccggtgtgccacgtgtcggaagcgcgtggggctgaccgggttcaagtgcaggtgcggagtgacgttctgc

SEQ ID NO: 749 - protein, 139 aa, Glycine max
  misc_feature (1)..(139): Ceres Clone ID no. 682858
  misc_feature (14)..(36): Pfam Name: zf-A20 Pfam Description: A20-like zinc finger
  misc_feature (118)..(139): Pfam Name: zf-AN1 Pfam Description: AN1-like Zinc finger
  misc_feature (1)..(139): Bit score of 180.9 for HMM based on sequences of Figure 3
  misc_feature (1)..(139): Functional Homolog Of SEQ ID NO. 451
MAEEHRCEPPEGHRLCVNNCGFFGSTATMNLCSKCYSAIRLKEQEEASTKSTIETALSSASSAKPSSSTSPPPSAVDVLMESPPPSAAEVEVAVTVTVAVASSSISINSGSVAQPNRCATCRKRVGLTGFKCRCGVTFC

SEQ ID NO: 750 - protein, 176 aa, Solanum pennellii
  misc_feature (1)..(176): Public GI ID no. 222822689
  misc_feature (140)..(176): Pfam Name: zf-AN1 Pfam Description: AN1-like Zinc finger
  misc_feature (14)..(37): Pfam Name: zf-A20 Pfam Description: A20-like zinc finger
  misc_feature (1)..(176): Bit score of 201.8 for HMM based on sequences of Figure 3
  misc_feature (1)..(176): Functional Homolog Of SEQ ID NO. 451
MAEEQRMQEGGGHRLCANNCGFFGSPTTLNLCSKCYKDHCMKEQQSRTAQLAMEKTRPQQQQQQQSESTSTYIPCTKPLPILEVSQPRETEIATRAPQVQSDTAAEVPQVQSDTVAEVPQVHTQLNDVADQAPQVQSNRCATCRKRVGLTGFKCRCGVTFCGSHRYPEHHGCTFDY

SEQ ID NO: 751 - DNA, 564 bp, Sorghum bicolor
  misc_feature (1)..(564): Ceres Annot ID no. 8644539
  misc_feature (1)..(564): Encodes the peptide sequence at SEQ ID NO. 752
atggccgccgcgggctccctcagccggctggcccgaggccacctggggtgcggcctgacacacaagacctggggtgtgtgttgttggctaacgataccattgctgctgtgcagccaattcttggtaacaatggcacacgagagctggaaacaagagtccgaggagactggagaggccccaattcagtgcataaacaattgtggcttcttcggcagtagcatgacaaacaagatgtgctccaagtgctataaggacttcatcaagctacacgatgctcccgccgccgccgctgccgaagccgtagtagacaacaagcaagcagaagaagcagcggcacaggagcagcagcagcccccaaacccaaagccgccgagcaaccggtgcctgagctgccgcaagaaggtgggtctgactgggttccagtgccgctgcggcgggaccttctgctccacgcaccgctacacggactctcaccagtgcaccttcgactacaagacggcggccagggagcagatcgccaagcagaaccccgtcgtgatggccgacaagatcaacaagatctga

SEQ ID NO: 752 - protein, 187 aa, Sorghum bicolor
  misc_feature (1)..(187): Ceres Annot ID no. 8644539
  misc_feature (128)..(167): Pfam Name: zf-AN1 Pfam Description: AN1-like Zinc finger
  misc_feature (60)..(84): Pfam Name: zf-A20 Pfam Description: A20-like zinc finger
  misc_feature (1)..(187): Bit score of 263.5 for HMM based on sequences of Figure 3
  misc_feature (1)..(187): Functional Homolog Of SEQ ID NO. 451
MAAAGSLSRLARGHLGCGLTHKTWGVCCWLTIPLLLCSQFLVTMAHESWKQESEETGEAPIQCINNCGFFGSSMTNKMCSKCYKDFIKLHDAPAAAAAEAVVDNKQAEEAAAQEQQQPPNPKPPSNRCLSCRKKVGLTGFQCRCGGTFCSTHRYTDSHQCTFDYKTAAREQIAKQNPVVMADKINKI

SEQ ID NO: 753 - protein, 176 aa, Solanum lycopersicum
  misc_feature (1)..(176): Public GI ID no. 222822663
  misc_feature (14)..(37): Pfam Name: zf-A20 Pfam Description: A20-like zinc finger
  misc_feature (140)..(176): Pfam Name: zf-AN1 Pfam Description: AN1-like Zinc finger
  misc_feature (1)..(176): Bit score of 198.4 for HMM based on sequences of Figure 3
  misc_feature (1)..(176): Functional Homolog Of SEQ ID NO. 451
MAEEQRMQEGGGHRLCANNCGFFGSPTTLNLCSKCYKDHCMKEEQSRTAQLAMEKTRHQQQQQQQSESTSAYIPCTEPLSILEVSQPRETEIATRAPHVQSDTAAEVPQVQSDTVAEVPQVHTQLNDVADQAPQVQSNRCATCRRRVGLTGFKCRCGVTFCGSHRYPEHHGCTFDY

SEQ ID NO: 754 - protein, 162 aa, Physcomitrella patens
  misc_feature (1)..(162): Public GI ID no. 168018442
  misc_feature (1)..(162): Physcomitrella patens subsp. patens
  misc_feature (103)..(142): Pfam Name: zf-AN1 Pfam Description: AN1-like Zinc finger
  misc_feature (21)..(45): Pfam Name: zf-A20 Pfam Description: A20-like zinc finger
  misc_feature (1)..(162): Bit score of 235.3 for HMM based on sequences of Figure 3
  misc_feature (1)..(162): Functional Homolog Of SEQ ID NO. 451
MAQDNWKQEKEETNCQAPDAPIMCTNNCGFFGSAVTLGMCSKCYRDFVLTQAKSSSGKGGEKGDTVYLGGHVGGGQTEGGGTSSGGGASASGGDACRPQAHRCFSCKKRVGLTGFKCRCGNTFCSLHRYSDKHSCTFDYKTAGRDAIAKANPVVKADKVDKI

SEQ ID NO: 755 - protein, 268 aa, Sorghum bicolor
  misc_feature (1)..(268): Public GI ID no. 242081565
  misc_feature (15)..(39): Pfam Name: zf-A20 Pfam Description: A20-like zinc finger
  misc_feature (209)..(247): Pfam Name: zf-AN1 Pfam Description: AN1-like Zinc finger
  misc_feature (1)..(268): Bit score of 197.7 for HMM based on sequences of Figure 3
  misc_feature (1)..(268): Functional Homolog Of SEQ ID NO. 451
MAERQQEVSGGGAAAPLCANGCGFFGSAATKNLCSKCYKEHLMIKTADDAAAAPVVDEKKIEVVAKAPPAAAHVMPEQLLGHQDPDDATAAVAVATATPVIAQAPTSATEKENGDPVETENHEASGGGGGGGSIKCAANGCGFFGSTATKNMCSGCYRDFLKDAHASPAVADKVVLAAEQLAAVQISAATSSAAPAVEAAPAAAPTNRCASCRKKVGLLGFPCRCGGTFCSLHRYAEKHACDFDFKAAGREKIAKNNPLVVAAKINKI

SEQ ID NO: 756 - DNA, 592 bp, Triticum aestivum
  misc_feature (1)..(592): Ceres Clone ID no. 1463779
  misc_feature (1)..(592): Encodes the peptide sequence at SEQ ID NO. 757
ccccccatttcgaagcccaccgaattcctcgcgattcctctcccctcgcctcctcgtcctccccctcctaggggatcgccggagaggaatcgcgacgagggcttcctcctatcagttaaatcaaagccatggagcacaaggagaccggctgccagtctcgggagggtcccatcctttgcgtcaataactgcggattctttggcagtgcggcgaccatgaacatgtgctccaagtgccacaaggagatggcgatgaagcaggagcaggccaagctggctgcctcctctttcgacagcatcgtcaacggtggcgatgccgcgaaagaacaccttgctgctggcagcacggcggtggcagttgctcacgttgaggcgaagacgcttattaccgcacagcctgctgatatcgccggtcccagcgaggcggcgatggagaaccccaaaggcccaagccggtgcagcacctgcagaaagagggttgggctgaccggattcaactgccggtgcgggaacttgtactgcgcgacgcaccgttactcggacaagcacgagtgcaagtttgactaccgcgccgcggccatggacgccatcgc

SEQ ID NO: 757 - protein, 154 aa, Triticum aestivum
  misc_feature (1)..(154): Ceres Clone ID no. 1463779
  misc_feature (14)..(38): Pfam Name: zf-A20 Pfam Description: A20-like zinc finger
  misc_feature (110)..(148): Pfam Name: zf-AN1 Pfam Description: AN1-like Zinc finger
  misc_feature (1)..(154): Bit score of 241.8 for HMM based on sequences of Figure 3
  misc_feature (1)..(154): Functional Homolog Of SEQ ID NO. 451
MEHKETGCQSREGPILCVNNCGFFGSAATMNMCSKCHKEMAMKQEQAKLAASSFDSIVNGGDAAKEHLAAGSTAVAVAHVEAKTLITAQPADIAGPSEAAMENPKGPSRCSTCRKRVGLTGFNCRCGNLYCATHRYSDKHECKFDYRAAAMDAI

SEQ ID NO: 758 - DNA, 441 bp, Sorghum bicolor
  misc_feature (1)..(441): Ceres Annot ID no. 8713173
  misc_feature (1)..(441): Encodes the peptide sequence at SEQ ID NO. 759
atggcggagaggcagcaggaggtctccggcggcggtgcagcggcgccgttgtgcgccaacggatgcgggttcttcgggagcgcggcgaccaagaacctctgctccaaggacttcctcaaagacgctcacgcctcccctgctgtggcggacaaggtcgtcctcgcggccgagcagctggcggcggtccagatctctgctgcaacctccagtgctgcaccagcggtggaggcggcgccggcggcggcgcccaccaacaggtgcgcgtcgtgccgaaagaaggtggggctgctggggttcccctgccgctgcggcggcacgttctgctccctgcaccggtacgcggagaagcacgcctgcgacttcgacttcaaggcggcgggccgggagaagatcgccaagaacaacccgctcgtcgtggcagccaagatcaacaagatctga

SEQ ID NO: 759 - protein, 146 aa, Sorghum bicolor
  misc_feature (1)..(146): Ceres Annot ID no. 8713173
  misc_feature (87)..(125): Pfam Name: zf-AN1 Pfam Description: AN1-like Zinc finger
  misc_feature (15)..(36): Pfam Name: zf-A20 Pfam Description: A20-like zinc finger
  misc_feature (1)..(146): Bit score of 205.8 for HMM based on sequences of Figure 3
  misc_feature (1)..(146): Functional Homolog Of SEQ ID NO. 451
MAERQQEVSGGGAAAPLCANGCGFFGSAATKNLCSKDFLKDAHASPAVADKVVLAAEQLAAVQISAATSSAAPAVEAAPAAAPTNRCASCRKKVGLLGFPCRCGGTFCSLHRYAEKHACDFDFKAAGREKIAKNNPLVVAAKINKI

SEQ ID NO: 760 - protein, 152 aa, Vitis vinifera
  misc_feature (1)..(152): Public GI ID no. 225455582
  misc_feature (92)..(130): Pfam Name: zf-AN1 Pfam Description: AN1-like Zinc finger
  misc_feature (3)..(27): Pfam Name: zf-A20 Pfam Description: A20-like zinc finger
  misc_feature (1)..(152): Bit score of 149.9 for HMM based on sequences of Figure 3
  misc_feature (1)..(152): Functional Homolog Of SEQ ID NO. 451
MDPPLCVNGCGFFGTPATQNLCSKCYKDFLKEEEEAAKAKTKSMEKAMGSTVASTSSVDDVVTSMTQLSLSSENTKKTISDDSSTKKKVERCETCKKKVGIIGFKCRCGSMFCAEHRLPEKHECSFDYKTMGREILKKQIPLIKPDKLEGRV

SEQ ID NO: 761 - protein, 165 aa, Oryza sativa
  misc_feature (1)..(165): Public GI ID no. 218189113
  misc_feature (1)..(165): Oryza sativa Indica Group
  misc_feature (105)..(144): Pfam Name: zf-AN1 Pfam Description: AN1-like Zinc finger
  misc_feature (12)..(36): Pfam Name: zf-A20 Pfam Description: A20-like zinc finger
  misc_feature (1)..(165): Bit score of 183.3 for HMM based on sequences of Figure 3
  misc_feature (1)..(165): Functional Homolog Of SEQ ID NO. 451
MSSEQQASAGQPVLCASGCGFYGNPATLDMCSVCYRQRCLLNGATMATGPSSSVAAASAATVATGAVTSDSCSVPSAEVNGAAFSSKNNPEPATVVEKKAPANRCASCKKKVGLLGFACRCGATYCGTHRYPEKHACGFDFKGASRDAIARANPLIKGEKLTNKI

SEQ ID NO: 762 - protein, 212 aa, Selaginella moellendorffii
  misc_feature (1)..(212): Public GI ID no. 302755624
  misc_feature (21)..(45): Pfam Name: zf-A20 Pfam Description: A20-like zinc finger
  misc_feature (153)..(191): Pfam Name: zf-AN1 Pfam Description: AN1-like Zinc finger
  misc_feature (1)..(212): Bit score of 299.2 for HMM based on sequences of Figure 3
  misc_feature (1)..(212): Functional Homolog Of SEQ ID NO. 451
MAQESWKCDQDETGCQPPEGPILCANNCGFFGSKATMNLCSKCYRDVVLSQAKVSTAKNALEQLPLLINNTNANNNSSAATAAAATTAATIAAATTATANATGMDQGVALDEQIVLPEAVTTSSEMNPSSGDGVADALVTSPEASGSRPPNRCNACNKRVGLTGFNCRCGNVYCALHRYSDKHNCTYDYKSVGRDAIAKANPVVKADKIDKI

SEQ ID NO: 763 - DNA, 813 bp, Panicum virgatum
  misc_feature (1)..(813): Ceres Clone ID no. 1778054
  misc_feature (1)..(813): Encodes the peptide sequence at SEQ ID NO. 764
ctctcgacgctcgacccgggaaaaaaaattctccgcggggggaaggggaaaggtcgcgtggtgtctcgcccacagcccatctgtagcaatggcacaggagagctggaaacaggagtccgaggagactggagtccatgcgcctgaggccccaattctgtgcataaacaactgtggtttcttcggcagcagcatgacgaacaatatgtgctcgaagtgctacagggacttcatcaagttgatggaagcccctgtggttgagaagaaggtgatcacggtggcatcttcttctgcggcaccaatggagacagcaaatcaagatgatgtgcctgcagctgctgccgctgaagctgttgcggagaagcaagcagagcaggagccgccaaagccgcccagcaaccggtgcctgacctgccgcaagaaggttgggctgaccggctttctctgccgctgtgggggcaccttctgctccatgcaccgctacaccgactcccaccagtgcacctttgactacaagaaggtggcacaggagcagattgccaagcaaaatccagttgtgatggcagagaagatcaacaagatatgatgcatggtcgtgtgtagggattgctgaattcatgcctgagttcctgagtcctcaagttcactccaaacgataggttccttcaggtggtggtctgggttagcgtggtagggggtctcaattgtgtctatccttctcctttatcatggtttcattctctcgattgtgtaataatgtaaatatattcaaactgtaatttaatcatattgcttcctacgacgattgctgggttt

SEQ ID NO: 764 - protein, 164 aa, Panicum virgatum
  misc_feature (1)..(164): Ceres Clone ID no. 1778054
  misc_feature (21)..(45): Pfam Name: zf-A20 Pfam Description: A20-like zinc finger
  misc_feature (105)..(143): Pfam Name: zf-AN1 Pfam Description: AN1-like Zinc finger
  misc_feature (1)..(164): Bit score of 353.3 for HMM based on sequences of Figure 3
  misc_feature (1)..(164): Functional Homolog Of SEQ ID NO. 451
MAQESWKQESEETGVHAPEAPILCINNCGFFGSSMTNNMCSKCYRDFIKLMEAPVVEKKVITVASSSAAPMETANQDDVPAAAAAEAVAEKQAEQEPPKPPSNRCLTCRKKVGLTGFLCRCGGTFCSMHRYTDSHQCTFDYKKVAQEQIAKQNPVVMAEKINKI

SEQ ID NO: 765 - protein, 176 aa, Selaginella moellendorffii
  misc_feature (1)..(176): Public GI ID no. 302822895
  misc_feature (21)..(45): Pfam Name: zf-A20 Pfam Description: A20-like zinc finger
  misc_feature (117)..(156): Pfam Name: zf-AN1 Pfam Description: AN1-like Zinc finger
  misc_feature (1)..(176): Bit score of 283.4 for HMM based on sequences of Figure 3
  misc_feature (1)..(176): Functional Homolog Of SEQ ID NO. 451
MAQESWKREEEAAGCQLPEGPVLCANNCGFFGSVATMNLCSKCYREQSSSKAAETMITTTTTTAAACATATPAAKEEALAAIATSRTSTTIATGATTLVTEDDSSASQEKPRLPNRCLACRKRLGLTGFKCRCGDVFCSMHRYSDKHNCSFDYKAAGREAIAKANPVVKADKIEKI

SEQ ID NO: 766 - protein, 172 aa, Glycine max
  misc_feature (1)..(172): Public GI ID no. 255638082
  misc_feature (113)..(152): Pfam Name: zf-AN1 Pfam Description: AN1-like Zinc finger
  misc_feature (15)..(39): Pfam Name: zf-A20 Pfam Description: A20-like zinc finger
  misc_feature (1)..(172): Bit score of 275.0 for HMM based on sequences of Figure 3
  misc_feature (1)..(172): Functional Homolog Of SEQ ID NO. 451
MDHDKTGCEAPPEGPILCITNCGFFGSAATMNMCSKCHKDMMLEQEQAGLVASSIGNIMNGSSSSSGNEPAIATSVDVSVNSIEPKIIPAQPLVASGSEESDEAKPKDGPKRCSNCNKRVGLTGFNCRCGNLFCSVHRYSDKHNCPFDYHTAARDAIAKANPAVKVEKLDKI

SEQ ID NO: 767 - protein, 132 aa, Vitis vinifera
  misc_feature (1)..(132): Public GI ID no. 297746352
  misc_feature (73)..(112): Pfam Name: zf-AN1 Pfam Description: AN1-like Zinc finger
  misc_feature (15)..(39): Pfam Name: zf-A20 Pfam Description: A20-like zinc finger
  misc_feature (1)..(132): Bit score of 274.5 for HMM based on sequences of Figure 3
  misc_feature (1)..(132): Functional Homolog Of SEQ ID NO. 451
MDHDETGCQAHPEGPILCINNCGFFGSPATMNMCSKCHKDMMLKQEQAKLASSFSFGSEGSGEAKPKEGPNRCSTCKKRVGLTGFNCRCGHLFCATHRYSDKHDCPFDYRTAARDAIAKANPVVKAEKLDKI

SEQ ID NO: 768 - protein, 181 aa, Glycine max
  misc_feature (1)..(181): Public GI ID no. 255640538
  misc_feature (113)..(152): Pfam Name: zf-AN1 Pfam Description: AN1-like Zinc finger
  misc_feature (15)..(39): Pfam Name: zf-A20 Pfam Description: A20-like zinc finger
  misc_feature (1)..(181): Bit score of 256.0 for HMM based on sequences of Figure 3
  misc_feature (1)..(181): Functional Homolog Of SEQ ID NO. 451
MDHDKTGCQAPPEGPILCINNCGFFGSAATLSMCSKCHKDMMLKQEQAKLVASSIGNIMNGSSSSSGNEPVVATSVDVSVNSVESKIISAQPLVASGSDESDEAKPKDGPKRCSNCNKRVGLTGFNCRCGNLFCSEHRYSDKHNCPFDYRTAARDAIAKANPTVKLRNLLRSRLLSLSFML

SEQ ID NO: 769 - protein, 208 aa, synthetic construct
  misc_feature (1)..(208): Public GI ID no. 13276697
  misc_feature (11)..(35): Pfam Name: zf-A20 Pfam Description: A20-like zinc finger
  misc_feature (149)..(188): Pfam Name: zf-AN1 Pfam Description: AN1-like Zinc finger
  misc_feature (1)..(208): Bit score of 158.3 for HMM based on sequences of Figure 3
  misc_feature (1)..(208): Functional Homolog Of SEQ ID NO. 451
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQASVSDTAQQPSEEQSKPLEKPKQKKNRCFMCRKKVGLTGFECRCGNVYCGVHRYSDVLNCSYNYKADAAEKIRKENPVVVGEKIQKI

SEQ ID NO: 770 - protein, 170 aa, Glycine max
  misc_feature (1)..(170): Public GI ID no. 255628269
  misc_feature (111)..(149): Pfam Name: zf-AN1 Pfam Description: AN1-like Zinc finger
  misc_feature (15)..(39): Pfam Name: zf-A20 Pfam Description: A20-like zinc finger
  misc_feature (1)..(170): Bit score of 287.6 for HMM based on sequences of Figure 3
  misc_feature (1)..(170): Functional Homolog Of SEQ ID NO. 451
MESHDETGCQAPERPILCINNCGFFGRAATMNMCSKCYKDMLLKQEQDNFAASSVENIVNGSSNGNGAVTTGAVDVQVEAVEVKTVSAQSSVDSSSGESLEMKAKNSPSRCATCRKRVGLTGFSCKCGNLFCAMHRYSDKHECPFDYRTVGQDAIAKANLIVKADKLDKI

SEQ ID NO: 771 - protein, 140 aa, Arabidopsis lyrata
  misc_feature (1)..(140): Public GI ID no. 297804888
  misc_feature (1)..(140): Arabidopsis lyrata subsp. lyrata
  misc_feature (81)..(120): Pfam Name: zf-AN1 Pfam Description: AN1-like Zinc finger
  misc_feature (5)..(29): Pfam Name: zf-A20 Pfam Description: A20-like zinc finger
  misc_feature (1)..(140): Bit score of 136.3 for HMM based on sequences of Figure 3
  misc_feature (1)..(140): Functional Homolog Of SEQ ID NO. 451
MTGEPSLCIRGCGFFSTSQTKNLCSKCYNDFLKDESARYLDTFNINPETAAEAAEEVTAEEETAVEAVVVKKKDKKSSSRCNACKKKVGLLGFHCRCGHMFCGSHRYPEEHSCPSDYKSAAIDVLAKQNPIVKADKLFRL

SEQ ID NO: 772 - protein, 135 aa, Vitis vinifera
  misc_feature (1)..(135): Public GI ID no. 297736227
  misc_feature (76)..(115): Pfam Name: zf-AN1 Pfam Description: AN1-like Zinc finger
  misc_feature (15)..(39): Pfam Name: zf-A20 Pfam Description: A20-like zinc finger
  misc_feature (1)..(135): Bit score of 262.2 for HMM based on sequences of Figure 3
  misc_feature (1)..(135): Functional Homolog Of SEQ ID NO. 451
MDHNETGCQAPPEAPILCINNCGFFGSAATMNMCSKCHKDLVLKQEQAKLAASSFESIVEGSSNCNAKESMGPNRCSSCRKRVGLTGFNCRCGNIFCAVHRYSDKHACPFDYRTAARDAIAKSNPVIKPEKLDKI

What is claimed is:

1. A method of increasing plant yield in soil containing elevated levels of $Al^{3+}$, said method comprising growing a plant comprising an exogenous nucleic acid on the soil having the elevated level of $Al^{3+}$, said exogenous nucleic acid comprising a regulatory region operably linked to a nucleotide sequence encoding a polypeptide having 95 percent or greater sequence identity to the amino acid sequence set forth in SEQ ID NO:2, wherein yield of said plant is increased as compared to the corresponding yield of a control plant that does not comprise said nucleic acid, wherein the regulatory region is heterologous with respect to the nucleotide sequence, and wherein the plant belongs to the Poaceae.

2. A method of increasing plant yield in soil containing elevated levels of $Al^{3+}$, said method comprising growing a plant comprising an exogenous nucleic acid on the soil having the elevated level of $Al^{3+}$, said exogenous nucleic acid comprising a regulatory region operably linked to a nucleotide sequence having 95 percent or greater sequence identity to the nucleotide sequence set forth in SEQ ID NO: 1, wherein yield of said plant is increased as compared to the corresponding yield of a control plant that does not comprise said nucleic acid, wherein the regulatory region is heterologous with respect to the nucleotide sequence, and wherein the plant belongs to the Poaceae.

3. The method of claim 1, wherein said nucleotide sequence encodes a polypeptide having 99 percent or greater sequence identity to said amino acid sequence set forth in SEQ ID NO:2.

4. The method of claim 1, wherein said nucleotide sequence encodes a polypeptide having 98 percent or greater sequence identity to said amino acid sequence set forth in SEQ ID NO:2.

5. The method of claim 2, wherein said nucleotide sequence has 99 percent or greater sequence identity to the nucleotide sequence set forth in SEQ ID NO:1.

6. The method of claim 2, wherein said nucleotide sequence has 98 percent or greater sequence identity to the nucleotide sequence set forth in SEQ ID NO:1.

7. The method of claim 1, wherein said nucleotide sequence encodes the polypeptide set forth in SEQ ID NO:2.

8. The method of claim 1, said method further comprising harvesting biomass from said plant.

9. The method of claim 1, wherein said regulatory region is a promoter.

10. The method of claim 9, wherein said promoter is selected from the group consisting of YP0092, PT0676, PT0708, PT0613, PT0672, PT0678, PT0688, PT0837, the napin promoter, the Arcelin-5 promoter, the phaseolin gene promoter, the soybean trypsin inhibitor promoter, the ACP promoter, the stearoyl-ACP desaturase gene promoter, the soybean a' subunit of /3-conglycinin promoter, the oleosin promoter, the 15 kD zein promoter, the 16 kD zein promoter, the 19 kD zein promoter, the 22 kD zein promoter, the 27 kD zein promoter, the Osgt-1 promoter, the beta-amylase gene promoter, the barley hordein gene promoter, p326, YP0144, YP190, p13879, YP0050, p32449, 21876, YP0158, YP0214, YP0380, PT0848, PT0633, the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, rice actin promoter, maize ubiquitin-1 promoter, ribulose-1, 5-bisphosphate carboxylase (RbcS) promoter, the pine cab6 promoter, the Cab-1 gene promoter from wheat, the CAB-1 promoter from spinach, the cab1R promoter from rice, the pyruvate orthophosphate dikinase (PPDK) promoter from corn, the tobacco Lhcb1*2 promoter, the *Arabidopsis thaliana* SUC2 sucrose-H symporter promoter, and a thylakoid membrane protein promoter from spinach, and PT0585.

11. The method of claim 1, wherein said plant comprising said exogenous nucleic acid has an improved growth rate relative to a corresponding plant that does not comprise said nucleic acid.

12. The method of claim 1, wherein said plant comprising said exogenous nucleic acid has improved vegetative growth relative to a corresponding plant that does not comprise said nucleic acid.

13. A method of increasing tolerance of a plant to elevated levels of aluminum, said method comprising
   a) introducing into a plurality of plant cells an exogenous nucleic acid comprising a regulatory region operably linked to a heterologous nucleic acid sequence encoding a polypeptide having 95 percent or greater sequence identity to the amino acid sequence set forth in SEQ ID NO:2;
   b) producing a plant from said plant cell; and
   c) growing said plant on soil having an elevated level of $Al^{3+}$, wherein said plant has increased yield as compared to that of a control plan that does not comprise said nucleic acid, and wherein the plant belongs to the Poaceae.

14. A method of increasing tolerance of a plant to elevated levels of aluminum, said method comprising
   a) introducing into a plurality of plant cells an exogenous nucleic acid comprising a regulatory region operably linked to a heterologous nucleic acid sequence encoding a polypeptide having 95 percent or greater sequence identity to the amino acid sequence set forth in SEQ ID NO:2; and
   b) selecting a plant produced from said plurality of plant cells that has an increased tolerance to elevated $Al^{3+}$ as compared to the tolerance in a corresponding control plant that does not comprise said exogenous nucleic acid, wherein the plant belongs to the Poaceae.

15. The method of claim 14, wherein regulatory region is a promoter.

16. The method of claim 1, wherein the plant is a rice plant.

17. The method of claim 1, wherein the plant is a wheat plant.

18. The method of claim 1, wherein the plant is a corn plant.

19. The method of claim 1, wherein the plant is a sorghum plant.

20. The method of claim 1, wherein the plant is a switchgrass plant.

* * * * *